United States Patent 10,233,495 (METHODS AND COMPOSITIONS FOR SCREENING AND TREATING DEVELOPMENTAL DISORDERS) - sequence listing, part 47

SEQ ID NO: 507 - DNA, 33862096 bp, Homo sapiens (residues 6,349,144-8,465,524 of 33,862,096)
ttgcctgtgccctacaatgcgaacagatggataaatgggtgtgtgtggggggggcgggtgtctcatggtcagatatgtgtggaaagtgtccagtcaaatgaagttaagcaagtttcattactgtaatccttccagatgtcagcatgtattttgaatatctaagggtggacaatgatttcactgagaatttcatggaactagattctggaagcactcagggaaaaactaaattatcacaacaccaggctgtcctcattagtatgcaatgtctatatttaaaaagctaaaagtcaaaggtcacctgccctggacacaagacttctgtcttgcagaggtcagttctaagggcctggaaaattccaagttattctggctaaccagagcacacccagaggggaaaggcagatgcagcacaggatacgctcaagaggatctccctctgtctgtccaggtgcactgctataaagaaacacctgagactgggtaatttataaggaaaagaggtttattttggctcacagttctgcaggctgtacaggaagtgtggtgctggcacctgtttctggtgagggcctcaggaagcttccaatcatggcggaaggcaggagagcagacgtgtcacatggtgaaagcaggagcaaggtaggggagaaggtgccacacacttctaaacaatcagatctcacacgaactcagagcaagaactcactcattactatgaagaggacgccaactctttcatgagggatccacccccatgaccacctccaaccaggctccaccacctctagcattggggatcgtatttcaacataagacttggaggggacacacatccaaaccatatcatctcccttcctgtgtcttgccgtatctcatttttttattattattatactttaagttttagggtacatgtgcacaacgtgcaggtttgttacattttgccttgttcacaagacagccttatgagctgcagagaatgaagccatgtcatcctttcatcccttatggtctctctgccctcatatatgcataactatcaagagataagatggtctcagcctcttaacaagttctcagtaggaggcctgaccatttgggaagcttttccttccaagtattcatgggctctcaatttaaaagcaaggacattaaatctactcaaggctcctgacacattcctggttccctcctatggtaggctgcttctaaagcagcttccaagaatcccacctccctgtagaagcctctctgcctgtctgtgggctggacctaatgactcacttttaagcaatgaatatgacaaaagcaatgtgacttctaacatcagttgtaaatgtctgtaaccaatctataaatacataaagcagattcattgttgctgagggctgggatgggggtccgagggctaggggttggggggtaataactaaaaatatatgaagtgtctatctacagccagaccaccctgaacatgcctgatcccaattgatcttggaaactaagcagggttgggcctagttagaacttggatgggagaccacctgagaatgctgggtgctgtaagctttataagataaaataaaatttaaaaaataaataaatataaaaatgaaaagatatgaagtttcttttgaaggtaacaaaaatgttttaaaatgtattgtagtgatggttgcataaatctgcaaatatactaataaccattgaattgtacaaattaaatgggtgaatagtatggtatgtaaattatatctctttttcatagcaaaactttgatcacattttattaaatataaggtaactgtaaaaagcattttaacgtctcttaaatcagtttgcattttacaatcaataatgtcttttgatcactgttgggatagactaagagcattttaaattaaaatttcttcatgagattttagaccacatgggtggtgtcaactcagaatataaatctgcttgcggttcaaaatctttttcccctccctctacctagtgctatgattgagacatgaaagtttccttgctgtttcttttcacatggtagtttcgtttatttctatcctaggcctctggttgtgagctgccctgtagagaagcccatatggcaaggaaccgaaggcagccttgggacaacaaccaacaaggaactgaggccctcgagccaataagcctgcaagcaaaggaatcctgccaataacacgtgcgtgagcttggaagcagatccttccacagtcaagtctaaagatgaccacagtcctggccaacatcttcagatgctgaggacccagctaaatgaccgccagattcctgacagaaaaacttgagataaagcctctaaagtgggggccatttgtcacacagcaacagatagctcatatacttcaaaagagttcctcggtcctctcctcaattttttattctttgccagacctctttttagcttccagaaaggagtcttacaaaaacctcctggtgcaatgcttcatgcagggattatgcagaccatccccgcccccaccccttgactctcaccactttcctttcctggaatgtccccttctgtctcctcaacatgcatatgatgttgagacttccttcaggcctttgtgttttttatgaagtgcaaacccaccttccagccatacactctctttccgagagtgattttacctgtctgagaatttccaggacacaagttgacacattgagcaacaatatcttacggtatctttaatgtgtaggtgaccaatcaggaagattgcttttaaatcgcttttcgggaaaaagaagtttattttctctcaatatttatatttctgtataaatttttagagatttgcatttcttttatccattgctctgattccatttttgtttgttcttcagtatcccattttatataactaaggaattcccatttttgtccttttcagagttatattatatggcactgtattttttcacatatttaaacttattcttatctaattgatattaatttagacttccagttgtctgctatgttgtaatattgtacttatgtttaattattccacatctatgtgtgtatttttagtacccgaaataccatctaatttcagccactatagctacttcatcatccatttttggattcttaagcatgtcttgcccagaacctttaaatggatttgcactagatttactacctttctcggcctgagaaagttattacagtttttaaagccccaaacttattaccagacattggtagcaaaggaaaattggttcaagttttgggaggctctaactcaagatgaacttcatttcattcaaggttcttctttatcatccttggatgagatgaaatttatgtgaaagtgtcctggaggcagagggtgcagtgagctgagactgtgccactgcactccagcctggacgacagagtgagacccggtctcaaaaaaaaaaaaggatataccaaaacataagtcaagttgtaaaactgagtatgaacatcaatgtatggatctagatatcaaatgttcaaagcattgaaacctatgaaattccagaaaataaatctttataaagtatattgtttcctgaccaaaatctaaaaatgttcttctatttattacactactagacaaaactctaaaatagatatttatatagtacaatcttgccaaatggctctgtgatggagactcggtgactcattgctttaaagaaagagccagcccagaatgtgccgaagtctttaagatatccatataacaaacagtgttgaagatagagatgtcatgtacaaggaaatgagaaagatactcaaaataaagagaaaatattttgcatagataattgaaatgaatgtgctttcatttccaaatattaaactaacactaatcatgataagagctaaatccccaggcagggcttagaaacccaagaggcatgtggggcccattaaccaaaagaggcttaagctcgggcgatgacagtatctgcaaacaaatacatttattaagaatgaaagtagttcagcgtccttgaagagcaaacttcctctaaagtgaagtagaaatttatttcattagcgaaaatgtctatttagcaccaaattggcacagtgtccacattgcctgagcaaactataaggggaaattggtgtttatttacatcccatttctcttcccaagggatttgaaagaccaggaggaagctattaaggagacagtcgtattttttccattgttatcctcatttatgatatagccattgccccgtcactaaaatagctgctgagccacttggtaaggcaaaagggaattctaggcaatacggcagactaagctgacacagacagaccctactcgttctgcaaagactttgcaaaactggacaaaatatatgcatattccagcttggggcagagggcagactgggtggggaatgtcctaggtaccagacacaaagaagcgatcaaagtagagtcataagtggcagacagtaacaagaccacagtggagtgtgtgacttgtatgatcggatctgtggactggggtctcggtgctcgcaagaagacaggaggcatggccttgggcctatacaaagtgactaagctagtactggtctcagggaaatccagaagtccacatgtgttacccacccatgaaatagagatgggaagaactatccactggcccagggacacggaggcttttcaaatccccagggcctgggtgacacaggtggaagcaaagaggcttcatatgacatagaaaatctggcatcgtgctatgttgagggtacaggcccccagctttgttcatttcgtttggaacctgaaaccaagaaattaacattaaaaactcaagggggaccagcaggagcaaaagaaagaagaaagaaggcaagcacaaaaggagctgagagagcacacaaacatgacaagcagggagaatgagcagccgaggactgggaatcatcatgccacctaaaaaagacaacacaataagcttctaaaaaggagggaagaggaaagagaaaggatagaaaccacagtgcaataacaaggtattctttttttaagaaaagaactatttagagaaacactacacagaattctagaaatgcgcacgcatgcccacacacagaaacgtacatagcttcattggcatgaaaaactccatcgaggaatggaggagctccagtttccaataatacaggctaaagtcaacctcccattgaaagcaacaaaagaaccggcttgcttgtagtatctcaaatcacctggaaacgtggaagacctcagaagctgtggaggcctcccgggctgatttttaggcgcacactgggactagggaagaaaataggtatcagacaccaaacctttcgtgcacgccttcacgtcactgtgacactaggaactcacacctggccttttgttctcattctaagagaaatctaatgggtcccacagaagaccttgccctgtacagtggtgagaacagacaacagataaattaactctactgcccgctccttagtccagaggacttgatctgagtggaaaggaaaagggaaagaaagcaaaagagaaggacacacacatggaagttgtgaccactgacccactctaacttgctcaagaaaaaataagctaaggataccttctgtcaccttttctactcaccattgttctgggaatcagaacacacacatagttttaataaaagacttcacatcttcataattttcagacaagatgactgtcaaatcacaaaaattctaactgaatctacaaagaagctcttggaactaataagagagtttggcaagatttttggatacaaggtcactaaacaaacatcaacagggttccagccacaatcaaccagaaaaaatatgttaataatcccattcacaatagcaacaaagagtgtaagttacctagtcacaaatcacataaagaaggtacaagatctatacggagattatggtatggacataagagaagatcctgcaatctcactcctgggttatacccctagagaaatgaaaacttctgtatatgcatgtatagagcaggtctaagcataatcacccaaaccaagaaacaacaaaaatctccttcatcttggtgaataaataaacaaaatgtggcctatctatacaacagagtgctattcaccaatcacatgaaatgaactattgatacaacttgggtgaatttcaaaggcattatgagctaaagaagccagtcttaacacaagttcatttatatgacattctccaagaaaaaactgtagcgctggaagacagatcagccattgcaggagttgggatggagaggacgtaactacaaaggaatagcattcaagagtttcagggctggcagaactgttctatatcctcatttgactggtggctacatgtataaaattaatagagctgtgtgcattaaaaagtaaatttcactgtatgttaattgagaaaataaaattttaaagtacaagaacagccgggcgcggtggctcacgcctgtaatcccagcactttgggaggccgaggcggatggatcatgaggtcaggagatcgagaccatcctgactaacacggtgaaaccctgtctctactaaaaatacaaaaaattagctgggcgcagtggcgggcgcctatagtcccagctactcgggaggctgaggcaggagaatggcgtgaacccagggggcagagcctgcagtgagccgagatcacaccactgcactccagcctgggcgacagagtgagactccatctcaaaaaataaataaataaataaataaataaataaagtacaagaactttttttaaatccagtttttaaaaaaactggatctgatgtgatgggaaggtaattcaatatggtaaagatgacattttcctcaaaatgaatctacaaattcaatgaatttcacaaaaacccagcagagtttaataaaacttgacaaatttatattaaaatttttaatgaagaataaagatctaggcataaccttttggagacaatttgaagagaggaaggacacggcttaccacataccaagaaatattataaagccctagtagttagaaccatgagaaagggggatagagatagataaacaaaacctgacagtgtgtacagttacaccaggaaatttataaattgctgttcatgcactattcacaatagcaaagacatggaatcaacctaaatgcccaacagtgatagactggataaagaaaatatggtacatatacaccacagaatactatgcagccataaaaaagaacaagatcatgtcctttgcagggacatggatggagctggcagccattatccttagcaaactaatgcaggaacagaaaaccaaataccgcatattctcacttataagtgggagctaaatgatgagaacacatgggcacatagaaggaaacagcagacactggagcctattggagagtggaaggtgggaggaggcagaggatcaggaaaaatgactgatgggtactaggcttaatacctggatgatgaaataatctgtataacaaacccccacgacacaagtttacctatgtaaccaacctgtacatataccccttaacttaaaatacaagttaaaaaaatatataaattggtgttcatttacatagattcaaatatctctcatcatctatcaatcttctattatctatcatctatctatcatctctcaatcatctagcaatcatctgttgcttatctatcatctgtcatctatgtatcatttatttattttctatcaactatctatctacctaaccataccccaggcacaaaaataaattctaatcagattaaattcctaaaggtgaaatgcaaaacataaaaaaagtactaaaaatccagaagaaaaaaatatgacagaaaaaaataaaggatatgaaaaaagtatgccccaagggccatcagtcaaataaaaattaaagcaatacagttttacttcacacccatcaaatatgtgaagatgcaaatgtttggcattcaaaacactggcaaagatgaagaaatgaactttttaaacagacgttatcacagcagttttggattaacagaaaagctacagaaagtatggacttcccatctgttaccttccaccacctccacagtcaacattttggtacttttgttacaactgatgaattaacattaagaaatttattaactaaagtccatagtttgcattgaagttcactctttgtgttatagtttttatgagttttgacaaatgtataataacttgggtccaccattacaatatcacgcagaataagttcactgcactgaaaactccctgtgtccagactgttgctccctttttccccctgaaaccctggtaatcactgatccttttactgtctctatagttttcctttttccagaatgacatatctttggaattatacagtatgtagccttttcaggccagcttctttcacttagcaatatgcatttaagtttcctcttatgtcttttggtggcttgatagctcatttctttatactgctaaataatagtccattgtcccagtgtgccacagtttgtttatctacttacccactgaaggacatattggtttcttacaagttttggcaattatgaattaatgggcttcttatatatcactgggagaaagacaaactgcaacaacagctttggaagataaggtggcaacatctaatgcagttgaaaaattcttaaggaagaataaagacctaggtatagccttttggggacactttgaaaagagggaggaagggcatgtcttaccacataccaagacttactataaagctctagtagttagaaccatgaggaagggccgtatacacagagctcagcacttccattcctaggtacacatcacagaaaaactcttgccaggaaacatacagaaaaatgtccattaaacactttctgtaatggggaaaattgcaaacaaactagacgtgtgccaattactgtattgggataggagacaattctccatgaggctctctcagatgtctgcacattttttcagcagaggcactggcagcttttgttctggatgatcttttcaagagtatttgtatggtgaacagcctcagaagatagtaatagtgtctccctctggagcaaagtttaagcagactggcttactgaccattgtaaaagatttgagttttctaacttcagggttcctctgctatgacaccaactgactgcatgtgtagcaaacacgtggactcctccacatcacctccatggaattccaggcacaaagagaactggtaaaaacatgaagctcctgctgttcactgtgacgtgagtaacagagtccattgtctgatccaagagtctcatgattgctgtcagtatccaaggtactgtggctggcaaaactcctcacatgaaagtagggtaaaatcttagaccctcctcagttcttgagaaatgggtaaataaaattttgaagtggttatacaacaggctgccaaagaacagaataaataaattaaaacagcaggtatccacacagataaatttcaataataggccaggcacagtggctcatgcctgtaatcccagcacgctgggaggctgaggcgggcagatcacctgaggtcaggagttcgagaccagccttgccaacatggcaaaaccccatctctactcgaaatacaaaatgaaatacaaaggtcagcccagctactcagaaggctgaggcatgagaatcacttgaacccgggaggtggaggttgcagcgagctgagatcacgcgactgcactccaacctaggagatagagcgagactctgtctcaaaaaaaaaaaaattttcaataatatatatatacacacatatatatatatacacatttatacatatatacacatatatacatatatacacacatatacatatatacacatatatatatacatatatattcatatatatgtgtatgtatatatatatatatatatattttttttttttttttttttttttgagatggagtcttgctctgtcgcccaggctggagtgcagtggcacgatctcggatcactgcaagctctgcctcctgggttcacgccattctcctgcctcagcctcctcagtagctgggattacagacgcccgccaccacgcccggctaatttttttttcgtattttttagtagagacggggtttcaccgtgttagctagggtttcaccgtgttagccaggatggtcttgatctcctgacctcgtgatctgcccgcctcagcctcccaatcaataatatatttttaggtgaacatagctaaaccacaaaatgatatatccagcacttccataaaatccgtgttgctttgagcacatatacatgtgtaaaatacaaacgggcactgacatataatcttcaggataatgcttaactcaggagaagcaggatggaggaactgaagcagaatttcttaaatcttatgaaaatatgtaaaaatgctaacatgtgttccttccatcagctgggtacagaagtttgctgtatagatccacagtctttatatgcaattctgaaaaatttgttcttaattctctttcaatgtatatacatacatacacacacacacacacatattttataatttaaaggtactaaaatgagggccaggtgtggtggctcatacatgtaatcccagtactttgggaggctgaggtgggaggactgcttgattccaggagttcaagaccaacctgggcaacatagtgagaccccccatcactacaaaagaggaaataaaaaattaaccaggtgtggtggcatgcacctgtagtcccagctactcaggaggctgaggcaggaggattgcttgagcccaggaggtcaaggctacagtgagccatgcttgcaccactgtactctagccttggggacagaacaagaccctgtctcaaaaaaaaaaaaaaaaaaaaaaaaaaaaaatatatatatatatatatatatatatatatatgaaaaagtaaaaagctctaatactaactagctctaccacttttaaaatgtaaaaccaaatgtgcattgcagaacgcacatgattctctacaaaacagagcccagggcataggtcaaggagccctgggatgcatcatgtcagcctggtgtccactcctagcctcatagtggcaaaaggaaatctgtcccttatgcacagcatggagaagaccattctggaaacattaatccatggtttttgtaattcctagagcatattctagaaaacaaatatattattttaaaacttggtaagataaaatgatacaagatttttctgtaactatgaaagagctaatgcttatttctgttcatattgcccttatggtccctgcttgactattagattcatgcctgatctaagagctccaggtcccccaagtgatgaataaagctgagcacttgtgtctttgggtaggatgtctcttacacagctcttcagaagcttttggcctctctggtctcctgtgccatcacccagctctgcacaggctctgagaagctccatgcagctgcaccctgatacctgtcagattcatgccgggagcctcctgccttccttctccctaagggcatctctgctggggtcatgggtgtcagctgactgcacactccgcgatgcaggggaatagttgcctgctgagggcgaatgtttgaccagaggggtttggagccaggtgacagatgctctcccttcctcaccctggctggctggtctgaaaaacattcctacccttcagagacagtgtcattgaatggagtaaccagtagcccatggtagtgacccattgggtaaatcgctcctgaattagatcctcctctcttcctgcccaacccaccttgtccgtggttcctgcccatgggggttactctccgcaataaaatgtcctacctcaggctcattctctgaaaaaattaagccaaaatagcctcatgccagtctcacatttccaggtaggtccaggtattttgggaagaaaggaggcttttctcctaactctaaaaaaaatcccagataacctcagaaactcagaaaaccatttctgacttgctatccatttctgtgcgctactttttacctatggcagtaaagatcttctctgaagatcaagttttcttccaaagcactcacctaaagtgtccctgttggcaaacaattcacaaacctgcctccgctgttgtcaaacgaccaaagctgacttattaagacacatccgtggtttccgggcattttaatagatggtagctcggtttcattcatgcctgtcggcggcataccctttgatcagaatgagcacttgctttgcttctctgatcctaacgatgaacttctacccatgcatccgatttgcctgacaagagccacacactggggcttggacttcacttctgtgactcctaaacggaaataaagcaattgacctgcgtgaggaaacacccccgggctacactcctccgcttggtgtcctgctcagcgccttacaccacacaaaaccaaatccaaatcataattgagccacaggacgtcttcctctgactttccatgctagcactcattctaacttctcttcctgcatgttctgtgaagcaataaatagaactaagtgtctttttaggacatttttattgcaacatgttgttttttttttctgcctcctgccatcttattatgttatgtcaccaaacaccagagagacacaaaacagatgttcccaataggaggaagcacagagggaatttccctatcagaaaccatgacgaggaagcgcttggaaatcagctatgctcatggtgatactatttggagccctgaatgtaaggtggagtgagaggctcacgcgcgaagggtagcactaagtttatctctgtggaataatgtaaaaggaaaacaatatcttggcaattaaaaaggaaatgaaaggtcaaatgcttcttgttacaaatgctttgagataatgtccaagtttctttgtggcactggaaaaaaaaagtttcacaaaaatgttgtttggaaggaatatactgctgcctagttcatgcacatttttataaacaactattttttcttgggatggcattggtgcattggagtacgactgaattttatgtctgacatatttccatacacaaaattccatacccccaaattcttaccttctaatgtgtacagaagaatgataatgtgaatgaaaataagaaagagtgaaaaataagaatttataaagtcctatttggttcattgcatatatttaagacagagatattagattatttataatcttgcagaactccatgcccctttttggaaatatgaactgaaataagtaacaatatagctcacaggcttcccattcaagaaagcagacttagcgcatattttacatcgtttctctcttaagacttctcaaattgatggtaaatgggtgatcaaaataacaaatccatgacaacaaaaatgttatggtgtaaagctattgacagatatgcaattccaacaaaattctacgtcaaagtttcctaatcccagcgctcttgacatttgaataattctagattatgagggcagcatctctgtaatatgtgtttagcagcacacttggtccctgtccactcgatgccagtagcatcttccctcacccccaactacaacaaccccaaatctcttccagacattatcaagtagctcctgggggcaccatcaccctcgtgaagaaccaatggtctaaagacagagagaaaatgaaggaatgtttactcacacaactgagaagagaaggctgcagcctagaacatttgtagagggtaccacagggcagaagacaggcaagctgcacatcagagcatccgagaaagtctaacagggatgctactgtgcaatagaagatcagagagatggaaggaatgagggagcagagaatactgagactgagtggagtctgtagacagaacaaaagaataaatacatgtgtacatacacacacacacatacacatacacatgcacacacatgcacacccatgcagatacatgccctcaaacacactcatacatgcacacacatctggatgcacacgcatgcacacatactctgtcacactcacatatgcaacagcagaatgtccatctacacatgaataaacagtatgtggtctacccagacaatgaaacattattcagccagaaaaggaataaaggactgacacatgctatgacatggatgaagcttgaaaacatcatgctccgtgaatggagtcagacacaaaaggccacacgttgtatgattccattgatatgaaatgtccagaataggtaaatgcatagacacagaaagcacatgagtagtaaccgggagctgccggaggaggaaaagggcagtgactgattagtggataaggatttcatttccggatgatgaaaatgccccggaactagacagaggaataatcttgtgaatgtacttaatgccactgagccggaaactcgtatgcttaaaatggtcaactttatgtgtattttaccccattttttaaaaaagaaaagaaaaagaactctgttggtgttgggaaatcagattactctgggagccgagggccaggtgttcccacactgctgagagcaaaatgcagtaaaaatctctgagtttaagcaaattggattgaaatcctagttactacgtataagtgaggtgagcatggagaagttaatttttctacagttgggtttccttttctgcaaagtacattccaggattgtcctgagagacaatgaatgaggcagatggaagctcctggcacacagcaggcccttcagtgctcacaggcggccctcctggcctcggtggctccattccactcagcagcataccaagctcttcttcatagccagcaggagccttattacatgctcaccatttgcagaatgtaacaaaaatctgctgcagcttttttttttttttttggccatggttttctaggtgaaggactcataccgctaagtgtaaccttcacttatagagcgtaaaaaagcctgatgcttaactgaaggaccacaagcatagctataataatattcaaacaatattttcaaatcatgcaagggactcactgtgagaattcagcctctatttaactggtgggattgttttcaaaatttctgtcttataaaaaactcgacagcaagaatctcaaaaagaagctgaaacaacagatcgcgtatgctttgtcttcttccacaactgcagccctgcaaacatacttggctgagtttatggtcttcataaagggctagctgcagtcacacttagtgtacccccttaagccagctgagaaaacaaagggattaagactgccaaacttcacggtggctttttgaaccttctcatgtctcccatgaacgcctgtaagatggaaaatctttgcaggccagcaagctgtccaggcagcagccttcttccgcctccccatccaccttagcccgcttcatctccctcccccacccccagccacagcccgcatttgcagaacacagcctttgcttgcccctttcaaatgcatcccatccactgacagaagccggctttgtttttaaaaacttttcctgtaatagctcaccgaggtcaggcctcagctcttgtaggcagctctcattaaacttaggttatcaaaggctttccttgccactgtcagtttgccaggcttaatgggaataagcagtgtagtgttcctattaaattttttttttttgagacagagtctcactctgtcgcccaggctggagtgcagtggcatgaactcggctctctgaaacctccgtctcccgggttcaagcgattctcctgcctcagcctcccgagtagctgggattacaggccctattaaatataagaagcattttgagcaaatatcacaagggttctagatttatttacaatttgtggttctcaacttggggcaattttgtctcccgggagatctgagacaatgtctgaaaacatttctggttgtcacaattggggagggagggttgctactggcatccagtggggagaggccagggatgctgccaaacaccctgcagtgcacaggacaggatcaccccatcctcctgcagcaaataaattaggggtcccagacgtcaattatgctgaaactgagaaaccttgacttagaggaacaccccaataatttaaacattcatctccctgccccccaaacaaaaaaccataactcatagaaatttttcttatctattcgttctttacgtatgttttcattcctgaatttgtttctgccttgagtctaattgggacttgcaccgcgggttgctacagagcctctgggcacattccttccttgttttgctcgggaagttgctaggataggagggaaagtctgcttgtttattcctaggataatcgatggtgcagtcaggccgagttcctgcagtacagtttgggtattttttttaagagatgaatcagattcatgcaatgaaattgcagggtttttgttttatttgggtcattcttcaattttaagagaatatatctcagcacaacatcacctgaacaaaagagaactagaagtgaaatccttcattaggtgatacagttgctccctgcccaaggagctgagtcctcagagggaacaggcctggcctttaaagggcagagttcttcccagattcacaaagcaggagatagagcagtgcttcccaaatgttgacatgcatcagaaacccctggagagcctgtgatggggcagattcctgagctcatgcctgagatgctgactcattggttctgggatggggctaagcattgacattttgagcaagcgcccagggaaggagtgcacgttgaaaagtaagcctctgtaatataaaaatgcacatcctaacaccaatatcacctgaagagactcatggctcattctaagttgtctatagaagatcctcatggtcccaaccaacttctttcccatatgtacttcgggctctgagttgcttctgttaaatcaagtttagcccgaagctgcctccttacatattttaagttcagcctaaaggtttttctgtacaatcgtgaactataacctaaatggaagtgtaaacagactataacctactcttgtgccaatcaccgagttttggccaatcacaggtgaccaactgttcaaaccgtgttcaaataaggcaaatgtctagctctaaccaatctggctgtttccatacctcacttctgttttctgtacgtcactttcctttttctgtctatatatcttcttccatcacgtggctgtgctggagtctctgagcctactctggcttgggaggctgcccaattcacgaatcattctttgcacaattaaaccctcttaaattgaattaagctacagtttttcttttaacacttcttcctgactctcctatttggttttgttgcacaccatgcaaagtgcaatggaaattctggggtgggacaaggtcaaggacagacttgagacaagaaatacaaagcacatgaggcaaagaatggagcccctgtgagcatatttgtcatggaaacacaactttacaatgtggcaattcttggttcactcactccaaaaggagcatggcatggtgccatcaaatataagtatcggattaacaacaaactatgtttaagactactatgcatggtgatggagtcaaagaagtatgaaactcgactctgcccttaggatcttatcaatgacttggaatcctggtccacaatgggtccaggcacaaaactaaaggccaaagagccagaaaggttacaacccacagcctgaaaaaggaggagcaccgttgtaagcattggtgcccttgtgcaacatagagactcactcctgaaaaaaggaacataagagattttgaggtgtttgtttttctgcaggcagcatggatccattttatctataatgttgcctttcatggaaaccagtgactaaagcaacaatggaaatatccacagcagagcaacttggagcaaatggcacttggacagggtttgtccatggaaacatctgacctctctctgagctccagaattgcaggattattatttctatgcccttaagttgtcaaggggaagacctgcctatcggaacatctgcataactcggagttttactgagcaatagaacattctgtacttctcagatccacatttactagtctatcctcaaaaggacaatgtgaagattaattaatctaatgttcatggagcacagaggagctgaaaatgcaccatagacagatctggccctcactcagtcaaccccgtcacacaaattcagttacagctggctgggtcttgaagcatggacatgatccgtatccctcctttagagggcttgtcattgaaatatctgccatttctccactgtccttcctaaatcagagatgtaaagcctgtggtttcttcaaggaaggttaagtaactggccttcatatgtgctaaataatgactttagttttgaaactccaaggaagccaagaaaggctttctatctctggcttgccagaggaatggttttcaaacccggtgtgcaaccctaaaagtcctttgtgataacttggcaggctaaagaccacaggatattgggccatgggagcagtgtctgaagagcacaaaccacccgatcactctatggtggaaactctactctggaatgcgggagcagaaggaaactatgaaggcattgcatgggcagtaggacatgccagccttccatccacctggccccagccattccccatcacattcccctgtcacataagaaacagtgcaccaactgcttttacattttagtccttagatggcaatttctgtgccttaactttgtcaaggtcaagacaaaaaggagtgtggatcagagatagaagcattcactcagcctaataggaaataggatcaggcatcaggcaataactgaaatgaaagcaaaatggatggtaataagtgaagatgtttgtgaactatccccaagaggagacaccttcctgcttaatataaatggcatatttctccaaagcacttgtcttctgtgaacctataaccagagtccatgaggtaaagggttttctcaagagcatatgaccagtcaacatggggactcgtgaaggggagcccaccagacccctcccaattccagaccccagtccctttccatgaaccatgtggtatgtatgtgtttatttattgccaacattgtataaccctacctgaaataggcagaaatgtaaaaattacacttctttgaattgacatatcctaaaccatgtatgcaaacatgagaccttaaataggagagaagtaaatgatttctgtcttctctttatatttggtctgcaaattgaggcagatactgttacagaaataccaggggttcaatctaggtcctgttgttcacttgctcactgctcaaaagccaatcactgagatgacgattattgccaaggaagaaggatttaatcgggtgctacagccaaagagatgggagatcaatctgaaatccatctccctgactaaaactaggagtttacatagcagagaagaaatgtaacaatgtgtgagaaacaggaactagggaagggcaaggaagcaatcatgatgaataaggggtgcagcatctcacaatgcagtgatctggtgagtttcagttcttttatactatatttagagatctgaaggttgtttcctgaaggatctcagatacaacaaatacaagtttcaagctttaagaccataagggtccatttctttgtttataaagaaaaaaaaaactatctatgggactactgggtcagtttcagttgggggcacttgtgcccctctggagacatttggcaaagcctgaagacatttttggttgttacaactggggtgagggatgttcctagcatctacagagtggaggccagggatgctgctagatgtcctccagttcatgggacagcactgcccttccccatccctacaagaaagaactaccaagcccatgatatcaggagaggcaaggttgagaaaacatgacctagactacataattatatcatcaaatctaaaacaataatatataataagatttgccattggaccaatcgaagaaaaggtccatgtggattcctgaaccacaccttctcactaaaatgtttgcatactggcaaagtggaaagatcaatgaattaaaacagggtgtcacacctgccagtctttctctgccccaatttgcaatctgcaacattagggcatgctgaggtgttttccatttcaaaatgccataaactacaacttgattatttttcaaataatcagaatatttttaacacaagtagctgctcccaaatgctcagcattaatgactagttaagtgttatacaatgatcatttcaaagcatcagtctagttccctgggttcatttgtttccatttttactacaatgtttttacataaactaacatcagatttatttttctaaataggtaaacttcaaatattaatttctactatgtgttttgtttactaaatctatatttcataaacagtaaaagatgatttatttgtttgcaaaccaaacccctagcagaatgttacaatgtaattactttttaattgtttaatctttattttttataacactcataagaaatcaaaacttgtttcttatatgtctaatttccactattatttattggctaaaataatggaaatgataaaaaggtaagaaaacaatcaatatatcttttactttcctacaactcccaaaaatacaagcctagatgagtcagtaaatctccaaatcttctatgtacctaagttgcaattacaagccagtggccagtgaactttatttttgctgattctgagtggccagaagacattaccttacaaatctcctagtcacatggtgcttgagaaaggaattttgtaccttttatttgtttaaaggctctaagaatgtgttttggggacattacagaaccacaatgatgtcaatgtcttccagctaaagactcaccaggaaatcacttgtagataattatggttgggttgactgactcactgcaagcaggaagaacacacatcctgggggaccatgagcatcccagtaaaaggttagaaaaagctcgttatagaacacaggcttatgttaggtgacttagggaaggattcaagaaagcagggctttgcttctggctggatgctatcagaaggcagaggccattacctaattaggcatcttgatacatcttgtccagaaggcaggaagtaaggctacaactataattagtaaagaagcagcagttgggaaagtgggaggtttggtcatttgggtggtttggacaatgttcatgtctctccccacattcggatgagattatggagtgaccttgtatttcctgacccatcatggtcatagagtagccttgtctgatgtgagggtcctgttcaactggacagcatcatggcctagctgtgagggccagactggcttccagctgtgagccacgttgtctttctggatggtcatcttcctcccgcctcacctaagaggcaattctgtctgctgccatctaagttcgcaaagagattgcttctgctggctggcaacaatcccttctctcatgctggctgaaaagagaagagtctctctggaggcctgtgtcatccaaagattcaaactaaatccttaatttgattcttcccttctgaaagtcttatttctcatcctcccccattccctgaagtgagtaggaactcacttggagttaggtatcatatttaatgtatttaacgagggcaccaacacctcagattgcattcccgttaggtgttagaggttccctgatttgcctggctcaaactcctcagttgctggattttagggaggtccaaggtacccagggacaagccagggttatggatgggcacacaggagctagaagcagtggttatttatcaactcatccaaaggttagaaagagtatgatatttttggaaaattgaagttgagttctatagtcaacaagtgggaaaaaaaaacctaggagccagtttgtgtgttgctagggtgttataagttgaattattttccagatactttcactctgtccctttactttctttttgttttttaatcttttattttttgtagagacaggatcttgttgtgttgcccaagctggtctcaaactcctagcctccagcaatcctcccacctcggcctcccaaagcactgagattacacatgtgagccaccatgcacagctatccctttactttcttaggggaaatatactttcccaccatattggagttaaccttggctctatgacttgctttggccaatgggaggttagcggacatgatatgtagaggcttgaaagaataaacgtgtgctggctggttcccagacttgtggatatgcccagagaaatcagcagagccacccaagtgaatccaagttagatcagccaaccccaacaccaccccccatcaacccacagacttgtgcactggtaaatgttcattattgtatgctgctgaagttttgtgattggttgttatacagcagcagctgactgatacactagagtaccagactgctgatttatgattcagccaatcacttgattatttccatctctcatccaaaaataaattccatagtgtacagatagcatgtttaaggtcatgggtacattgcccaaagttcatcataaaacaaataatgtactgacaagaggggaaaatgaatatgttaaggcaataggataaaataaggttataatttgagtggtcacaaatagtactgtcagaatgcaaaataaggtatttattcatttatacattcattcaacaatgtttattggtaagaaaaatacaatgcaaccaatactgataaaaaccagcaagacagtcatgggatagacattatcctatcctcgtgagggtaataacagaggatctagaggtttgcagtgagaatttcataaggattaaagaaaaattaaactcaatggattggactccatgctccagccccttgctctttccccaccttgtgttcttatcactgtgtttcttgcaatgaccaatcagtctctacttcttcacaggctgagaccagagaaaataaaaagggagagatttctggtgccccaaattaaatttgcatgcccagaagtatcctgagactccagaagcacttcccagtgagagctgtgaacatccttttcttggagatatgtaggcaatgggtatgaaaatagccttggggaaaagtttgaaattcagttctgccccatggaggttggagagcagaaccaagtaattgtaagagcctctgactctctggttggtctctgaaaaaatgactatccctgggcagggttttgtttcccattttcaattcagctggctctacatttgaggtcattaatggattgtttaatgtgtattccattgtagcagctagtctgctttcagaaataagctaaaataatcgatttctaaaaatatacttcaagtccaattgcttttggcatatcagacacaggcagcatttcctacagaaagtttagcaagtggaatatttttgtagacccagactcagttgcagtcatcaccacactgacaaccatctgtatcagtctacttatcccttcccattttgttcaagggaagtgaaagtgaatgggcagaacccgatgtgttccaggaaagtagaagagaaaagtaatggaggcatagatgttaaagaaggcgtcgtgacatgcaagttactcttttacttatatagttaataagagtgtactcacaattcgtgcaaaaagaagcattaggaagcctactgaaaagaaaattgtcagttggtatcaccaccaacaactggacttaatggcctgctgttccccatgtgatgcctgcaagggatgcagctgcgtgtcggtggcatgtctgccccaaaaatgtagaactggaacctaatcctgggaagcctcaggccagcccaacttgagcgtatttttcaaaacacttggcctgtaccttctgaaaatgccaatattattaaagacaaagaaaacacaaaaactaaatacaatgtggatcagagaatcctaaatgggggaaaagttttccatgaaaaatattctcaggaaaataggtgaaatctgaatatcaactgtatatctgacaatagtaatgtatcagggaaggtggggaaggttaatgggtacaaaaaaacatagttagaaagaataagacatactattgaatggcacaacaggtgactatagtcaataataactgtacattttaaaataacagaaagagtgaaattggattgattgattttaactcaaacaataaatgcttgaggggatggatacccagttttccatgatgtcattatttcacattgcacacctgtatcaaaacatttcatgtattccataaatatatacacctactatgtacccacaaatattaaaaattttaaaaagattagacagtactatacgatgctgtgataaaaagagtaatgtatcaatattaaatttctttcatttgataatcatggtgggctttggaaatatgctctaaaatattcaggggtacaggtataatgtcaaaaattcactttcaaaaggatggtgggatggttcagaaaatgcacagataacaagcaaatggggcaaaatgttatcatttggcgaatttgctgagggttcctgcgaatacattctaggccttttgtgattcctttataagttttagtctttccgaataaaaagttaagaattcttcagcaaaatttcttaatgtttaaaggctgtggtagcataaattactaagaaatcctttactccaccatctgatacgtaatcagattgaactttaactctgttagcatgaatttgtggtaaaaatggcattcaaaacaggaaatttcctgacctaagaaatagctgcttaaccttagctagttgctcagtggaatccacaatttgttaggatttacagaatgacaatactgattgtaaatttgaaagaatacaattgaaataactagtgttatttttaaaaaatcaattgccatattcaaccaaaaagaataagattagtggggggtggtctgacccctaggcagctggaatttctttttttttgctttttttttttgagacggagtctcgctctgtcgcccaggctccgcctcctgggttcacaccgttctccagcagctggaatttctaatgtagcagaaaatcttaatgcatggccccaacttcttgtctacacttgacttggctgctacaagattagctctttttttgtcaaaatggctgcattttttaaataaagttgcttgattaaatttatcaactattagccaaatcagtattttccaagttagtttaaaaaaaaaaactgaattttctgtacattaagtcatgactgggggcatttttagaaaaaaattttaaaaaatcaaatatatctttacaggagaaagggaactttaaggtctttgaaatacatcaataaataattttttggttctcattctttaaaacatttaaactgatcatatttggaaggaaaacacatacgtggcaaataaattgtaaaggagtaggaatacctccttgaatgggcccatcctttcgtaggaatacataaaatctttcttgttattcttaatgccagaaagcctgaaaggcgaatgttttgctgacctccaagaatggctaaagccaatgctcagcagtaggcaccaaaacaagcttccggggttgctgaacgccgaagcatgtcgtctttctgccaacagtaacctcccacacttttctcatcccttatgccataaacccacctctatcaggtgccgggctaactcctgctcattcttccaaactgctgtatcctagaagtgtctccgtaacccagaatgccaggtgttcccttaggtctccatgcccctgaattctcccagcatagcacctgttaaacactgggaaactgtctttggtctttcttctcacatgataatctctgacagcacagaccctgttcttcttactcacctttgcacccctaatccctagacgggtgtatacagcaaaaactcagtaaatgtctgctggatgaatgatttagacgtcgtagcccatccttcgtgacacattgatactgaccatactatgtaggcattttctctttccccactttttctctgtttaaaaaatataacttagtgtacgctctgctcatggagagttacaagttcaaatcaaacacgtgagctctgactcaatcttcaccatctgcccattcatctggagatcatctgattttctctgggatttttgtagtgcaaaaaatgcattatacggaccagaaataaactagaaattgtagctggcgcattttgtgggtcaggatatattttttaacatttaaggaacattgtcaccccatgggagactgactactccaaattgaaactctcagttttattcaagctggtaactttccttctcaggctcacccctaacaaagctccagaataaaatgttacagggtgactgaatgctcattcgtaagttaattgcttgtagcaaacccatggctgcctaataatacaaatacactgtacatttgtctttcaccgttcattgtgtaaaattacaggcagctagactatgtttgagggacttgtttatatagtgccattgctgaaaataagcatttaatcataaatccattaatcaaaactaaaccaatgatcctgcttttctccaaaagaatatatccattttcccaatgcattacaataagttcaatgaatattaaactcacgatgacagagattctcagaaagagcatttggcagctctattctttaaagtatttactgggactttcaatatgataatccaacacactttgaaaggagctggcaagaggactgcaacaatccactgtgccttccgatcaataactaattcatcactaccaactggcttcttcagaggacagaaccagctctgctgcccaggctggaatgcagtggtgtgaccatggctcactgcagccttgacctctcaagctcaagccatcctcccacctcagcctcctgagtagctgggactacaggcgcatgccaccacacttggttaattttttaattatttgtagagatggggtctcgctatgttgcccaggctagtcttgaactcttgggcttgagcaatcctcccaccttggcctcccaaagtgctaagattacaggcttgagccaccacactcaggctatcaatgacttttaacaagcacaacagaagatagtttatcatgatgtctgtgactattccttgcagcagcacctctcatttgggaatgtctggagacatctttggttgctgtatcccggaagagcagtgctattggcatctagtgggtagatgccagagacgccgctaaacattctacaatgcacaagacagccccttgccaccacaaaaaattacctggcccaaatttcaatagtgctggtggttgagaagtcctgccttatagaaggttaacagatgtaatttctagatctgtaccattcaatgtggcagccgctagccacatatggctatcaagcccttaaaatgtggccagttcacattgagatgtactctaagtaaaaaatacacgccagatttcagacttagtatgaaaaaagaatgtaggataccttaatatttgataatgaaattttatattaaaataataggttggatgaagggttatattattaaaattaatttcatctcttcctttatactgttttaatgtctactacaaaatgtaatatacatatgtggctgccctgcatttccctctggacaatactaggctggggggttccttctgtttccttgatgatgtgctgtctctatccatgtaacccacattgcgataagcagttctctcaaagtaaatttaaattcaaaaagcacccattagctatattcttatagggtaaataaaagtgccaagttatttaatcagatcaaagatacatgaagtacaaattaaagtttccctatttctgtttattataaaaccaagctgagatgaagcaaatgaagcatggagatgcattttcctttatgcccaaatggtaaggaattgaccccttagcaaactgtccaagtcgacaaattcaaaagctggaaggcaaagaaacagggctttcaacagcaagcaaatattatatttccaaggagagtcaagcacagtatcttgctcattaaaaagaataaacctgagaagagcacaaaaattaggcagatctgttaaaatgattagtcatcagactagcaacccttctaaacacagcacaacaggggcagggctggatggtagagaaaaagccacaggtcctttcttaaagatccaccttaaaaggcaggacagacagttgaaaacattacatattgaaacatgagaatgaacagggatattccaaattccaaatgagagttcagagtcaaaaccagaatcagtgaggtgccatacttgggcatggaaataaaggtagaacttagaccaataaaaaaccatgttatgcataagacggaagtgggaagcagagtaagctaattctcagagctgaaataagtatgatgcttgtgactgagacagtcgtacgagctgacttgccaaggctttgcatttatgttgaggagggtgtagcaactggacaaacttctttgtgatgggccttaacaaccagaatgagaacttagaactttatcccataggcaacagggagacagagaatggtatggaaagagagagaagtataaggagaacattttagacatgtacatgaggtggatcagaaagagaagaaatggccaaacaacatgtaattagcttaaatgtataatgatgaaccaccagggtggtagtactgtagctaaaagacaagacaccaagtgaacatcagaaacagaaaataaagatgactccaattttgagttggagtaactagggaggaaggtacatagatacaacaatgaatgccatgggggcattgacattgggatgattgattgttggctatcaaggctgggactcgggttccaagaatagagctataaatgtaaaggtcaaactaatagatataccacgttgcctattattttataggacattaacaacagtctgtgggctaggttgggaggtacattcatctccacggtaccaagaggtcaaggttgcttggccattgcatgttggagccggaccaagaactcccagagttctatcttctaggattgctttcatcccaatgtgccacactttttccctctaaactgtgcagattctcacccagcgagggtggtcaaagctacaaataggaattctgagagagagagagagagagagagtcaactaagttgggcaagtcttgaattgacagaaaatcctgttttctaacctagatcccatgcactgggtccagttagaaccatccatgatgttcttagtttgtgcacccttcctgcctctcagcctcattgtccacttgtctataccctagattctcaaattctattacctgagaaccttggtaagtcatgataatatccactgaggagtaatgacccatataaacttaaaaggccacccactttggaggtacttgcattttaacaagggcctcttgaagacacagtccttcaaaagtctagaatagtaactatgattcagtgattcagatggtggagttgggggaatatttcttcatgataatcttcaaatcctgcaatcaacatatacataggacctgccttattacagggataagatgtagatttctcctccctgtactcccaatcctatttccttggaatgccttccaaatgtgatttagtcatcactagaaaccagtatctacacctgaaagggaaaaaaaaatgttttcaccaaagtgctatgtcacctccatgaaggaaaatacgaaatacagggctgtgaatcttccccaactcatctctaggatgataaatgaatatcaaagaagtatgccaaaagatgatcaatgaggggctaacatctctgctcacagggagttatcacagtgaatttggtgtacggaaaaccaaagctcttccacactcattccagcttcagttttaagggaattttgactttgttgctgtgatatgtaagcctccccttaactccaatggcaaatgctttgatatagaaaataagtagcaggcaatgagtttcacacacttaccttgaactttaatgagcggcgatttcccctctggtttctgaaattaggtgtgtcacatgctttaacacaatcagcttgtcctaacaccatggcaataactccatctgcctgcagatatgaaagagactgcattatcagtctagtattcatcatcaacaaaacaccaagcaaatgtatggtcagcattttaaagtgtgaaaatatgtacaactattatgtatcaataaaatatacttttaaaaaagaaaaataaagttaagtgtgctggcgatgagaataccttgatgtctaagagttattaagtaccaaaatgataactgataatgttgtttaaatattttgttaaaaaactattctctaattttcaaaaacattgaggacaaacttaaagcccatttatttcaccagccaatctagttatattgagtgtagtaggaagtatatcattcttggaaaaagaaaaaaagactgattaaaatctcagataatcagacaaaataacttggcttctaagtgttgttagtcacttcctgacaatccaacatttccgagtaggattcaagttttcacaggaaatgtaaactcagcatttctaccattttcttcatggaaatacagaagcaataaaggagaagaagaaaaaagtttttcttaaattcatttttagtaaaacaaggagttaaaaccccagacctcagtgtcaaaatgactacaaatgtcagtggagattgatcagggtgtgttgcagaggagacagaggtaaacaaacatcacggggatccaacagcagctggagatttgccaaagagcagcagaagcacgcttcccaaatagaaggggcacagccagaggcacacaactttaatcatgtgtttgcaagaatagaagtcacggtgaaccagctgcagcggaagcctcctgcacccaattaggttccagaagcagaaaaagtgaattaaatgaattatatttgcaggcattattctgtctttatggcatcaagaaaaggagaaatttaagttgttagcaaagaaatttgaaaaactagcctttgttggctgagaaacaaaagctaaagaaacttatacatggctgggaacagtggctcacgcctgtaatcccagcactttgggaggccaagactggcagatcacctgaggtcgggagttcgagaccaacctggccaacataggaaaccctgtctctactaaaaatacaaaaatcagctgggcatggttgcaggtgcctgtagtcccagctacgcaggaaggcaaggcaggagaatcgcttgaacccgggagatggagggtgcagtaagtctagattgcgccattgcactccagcctgggcaacagagcaagactccatttcaaaaaaaaaaaaaaaaaaaaaaaaagatattccaaggaccagtaagcacaagaaaattgttcagcctcattagtcatcaggaaaatgcaaaatataaccacaatgtgataccaccatacacccaccagatgacaaaaattgaagaccgacaataccaaatgacgttgaggaattggggcaactcgaatctcaggcatgcatgttggtaggagtgtaaaatggtacaatcagtttggaaaaaagtccgagtttcttcaaaagctaaaaacctaccccatgacccattgtattagagtgttcttgcattgttacgaaaaaacacctgcaactggtaatttataagaaaagaggttcagctggctcacagttctgcaggctgtacaggaaacatagctccagcatctgcttctggggaagcctcagggggctttgactcacggtagaaggtaaagcaggaggatacacaacacatgaccagagcaggggcaaggggagtgggggcggagcaggtgccacacacttacaaccaatcagatccagcgataattcactatcatgaagacagcaccaagatatggaggatccgcccccatgatccgaacacctcccaccaggccccacctccagcatcaaggattacaaatcaatatgagatctgggcggggacacatatctaaactgtatcacccagcagttctactcataggtatttgccccatcccgtgccaaggaaagggaaaacaaaatgtacgggaccacgaaaaagagctgtgcaagaatgttcataacagctttattcataagcaacaaaacctgcaaacaacccaggtgttgcttaataggaacacagagaaaccaaacataggatagtcatgtaatggaacagcacttgccagtgaaaagcaacaacaagaagtctcaaaaacattatgcttagtgaatgaaagaaggcgtccacaaaaagagtgcatactacacaaaattctagaacaaataactcatgtatggtggtaaaaggtcagagcagtggtaggctctgagggagtgggcatagggattaactggcaagaggcatgaggaaaccttctagggtgatgataatgagctgtattttgataagcattacacaagcgtatgcttttgtccaaacccagtgaatgtgcacttaagatttgtgcatttcactgcatgtaaacttcagctggaaataaaaaatactacaaatactaaactctagttcatgatgtgcatgctgaagtatttaatgggatgtacactggtatctccagtttactttgaaacgcgtcagaaactaagatggattagtgtatagagggccaaatagatggatagatacatgttaaaggaaggttagtaaaatgttaatggtagaatctaggtggtgtgtaatgggtgttcactgtaaaattctttcaacatttccatatgcttaaaaatctgtataataaaatgttggaaaaagtccgaagaaactaaaacagtaatgaaggaagattagccctgtatatagcatgctgaaacataaataaaaccttaatatttaacttaagtagacagaaagatcaatggaacatagtagaaaattcagaaacagaaccccccatatggaaagttagtatatgttataagtggcaactcaggtcagaagagaagaaatggattatttaatagttttgagagaaatgagctgccttctggaagaatatatttggttctatgcctcacaccttatgccaggataacttcccaaatgatcaaatatttaaatatatataaatatgtagaattcagtgataaatgaaagaaaccatgggataattcttctgttaatactaagggggaaaaatcctttcaactatgacccaaatgccagacatgataacagactgagtaattcaaccacaaaaacgtcagaactcttcaagcaaaaccacaataagcaaactcaaaagacaggtggcaaactgggggaagattgtgagatctcataaagttaatttctctaataaacaagtagcttatggctacaatgaaagaaaaagatggaaaacaatacgaacaaataattcaacagaagacaaatggtttttagtcccatacaattatcctcaactacaaacataataatggaaaaaatggattgccatgtagttttaacttgcatttctattagaagttaaaaaaaagccgcagtgtataattcactttaaaaaggagagaaacacacacacacacacacacacacacacacacacacacatacacattacaacacataaaaatgtgctcatagatatttttaaaagctccagaacgtgcattgcttattcagggtgacagggatgttttttaacagcttatccttttatactttttaaattttgaaccatgtaaatggaatacctaattttaaaaattagatttaagaaagtgagaataattatattgcaaacaaaggcagcagcgtgggaggcagcccaagctccagcccaactctgctactaattaactgggtgaacttgggccagtctcttggaatcattgactattctggctgcaaagaatctcagaaatattctcattccacacttgttttatggaataggaaacagaagcacagaataaattaagtgacttagccaatgtcacatgcagtcagtttactgcagagccaacaaaagctgtagatgtgtcagtttcttcttagataagatgggagtactgccattaagaaaaggcaagctgcagagatggggagaaaatatttgcaaatcacataactgacaaaggacttatatccagaatatatgtttttaactctcaaaactcaacaataggaacaaaaataaagatgcttaagatcattagccatcagggatattcagattcctaaaaaccacagtgagataccactgtgcattttttaaaatggctaaaactttaatttaaaaaacctgacaataccagattggaaaggatatggagcaactagaactctcacgcattgctgttatacaaaatgcaaaatggtacaaccactttagaaaacagtttggcagtttctcataaagttaaacatacacttaaccaataccacataacccagcaataccactcctaggtacttatccaagagtgccaggcactccagcctgggcaataagagcaaaactccgtctcaaaaaaaaaaaaaaagattctttcactttttaaaaaacaaatagtaattaattcccaaggactagaacaggtttgtattacatgtggcacaaaaaatcttataatttttctttaggaaagataaacctgaataactatgaaattcataacacaatgacaatgtggagagacagaaaaccctgtaaacttacgtttacaaaaaaacctgtacataagtgtttacagcagttttatttttagtcttcaaaagctagaagcaacccaaatgttcatcaactatagtacatccatgcaagagactattatgcatccatacaatggaatattatgcagccataaaaaaggaacaaacgattgatacatgcatcaaattgagtggatctcaaaggcacaatgctgagtgaaagcaaccaacctcaaaaacctccacagtgcatgattccatgtatatgacgttctgggaaaaggcagaattgaaggaatggaaaacagatcagaggttgctaaggactggggcagggagagaggttgactaaaaagcaggagcatgaggaaattttagaagatattggaactgctctgtgtcatcattgtagtgttggatacacaaatctatgcatttttaaaacccacagaattgtataccaccaaacgcatactttacaatatgcaaatttaaaaataatttttttccagccttcttgaggtataattgacaaataaaaagtgtatatatttaaggtgtacaacgtgatgttttgatatacattgtgaaacatttgctaccataaagctaattaacatatccatcactttgaagagtgaagtcatcaatcaaagatctctgtgatcctttccagttttagaaacataaagattctttcactttttgtggccgggcacagtggctcacgcctgtaatcccagcacttttggaggctgaggtgggtggatcacctgaggtcgggagttagagaccagcctgaccaacatgaagaaaccctgtctctactaaaaatacaaaaaaaattagccgggcatagtggcgcatgcctgtaatcccagctacttggaaggctgaggcaggagaattgcttgaacctgggaagtggaggttgtggtgagccgagatcaggccattgcactccagcctgggcaacaagagcaaaactccgtctcaaaaaaaaaaaaaaaagattctttcactttttaaaaaacaaatagtaattaattcccaaggactagaataggtttgtattacatgtggcacaaaaaatcttataatttttctttaggaaagataaacctgaataactatgaaattcataacacaaagacaatgtggagagacagaaaaccctgaaaagagtgtaaaaataatgtcttggaatttcatctccttgacaattcagctagctttcaggcattctaatttttctctcatttggaagtgcaaagttaatagaaaaatagaccagtctatttttccgtatttctatatctcactgtttaagttttgctgatcatattttaaacttcctttttatttaaaggtgaaatcattgataaacaccatctcttacgtatccttttctctccctcaaagcttgttcttgtgacatctggactgtctagaaagacatgatccttcaaataattccttgtttagttacaatctcttttgttccaaaaacttccagtaaaatatctctcatatagtgttttttacctttttagggtgatgtactcctttgagaatacgatgtaagctataactctatttgaaaaggtttaaacaaaaacaagaccataaatactgtcttagtccatctgtgcttctgtaacagcatacccgaggctaggtaatttataaataatacaagtttatttcttatggttctggaggctgagaagtccaagatcaaggcaccaataggttcagcatctggtgaggactgctctctgcttgcaagatggggccttgttgctgtaccctttggaggggaggttcactgtgtccttacatgtcagaaaggatgtaagagtaagagagtgcttcttcaaccttgagccctttaaaagggtgctaatcccgtccatgagggtgaagcccttgtgacttgcttcccaaaagccacacctcttaatacctttgcattggggattaagtttcaacttaaattttaaaggagacacctttattcaaaccatagcaatacccccacatacgcaattctggtgacaatgtcagaggttcaagggctttctgagtcctgtggatttcaggattccaggtatatagagcacaagctcctgagggaaacccttggttcaaacccttgcactgctatttaacggctgtatgacgttgggcatgtatttttcctttctctgcctttgtttgctcatccacaaagtgcaaataatagtactgctaggggctagacgtagtggctcacacctgtaatcccagcactttgggaggctgaggtgggaggatccctgagaccaagagtttcagatcagcctgggcaacatagccagaccccatgtctacaaaaacatttttaaaaattagctggctgtggtggcacatgcctgtagtcccagctacttgggaggctgaggcaggaggatagcttgagcccaggagtttgagactgcatttggccatgagcacacccctacactctagcctgggtgatagagaaagaccctgactcttaaaaaaaagtgctactaggatttaatcatgccttgtcactggaaggcctcaataagtatcacctagagggtgaaagaaaaattgactcatgccattttccaaggcttctaagtcagcctccttagaaatttggattctatagagtatcgtcaaagtgtcatctgcaatccactgaagtcaactgaagtgcctcctgttgggagatccagaaatgcaatgttatcaaagcaaattatgtgcaattccatagactttcattttctaatgtatgactatgggctacaactggtaattgactgagttattaagagttaccaaactaaaattagcacattacttgattttatccatgactctaattagttttctactcagactctgctgccaaacaacccatggcaatatcacaagatacttgcatctcatgcctacagatacttggcatcttctagactggaggaaggatgcttgttatcacagcatcatcagcattgtcttgactgagggatggttttgattgttgttactcttaactttgatgatttatattttataattggtttcatcattatcaattttgtttactgagagtcattcaatggacctgaggacaacaatagtatcaatcatattttggcctataattttccaacgatttggttttaagttgtatatgtataacatggttccaatgggaatcattcaaattctgatggctatagtacacatgcacacaatctcccaaaatattctcatattctcactattggcacccagtgtttggtttttagggggaaggggtggggttgctggtttgtttgctcactactggaaagtaaaggttggtagtagagatgagagaatgaatacagtcttttttttttctgtcaaagtagaccatagtaaaacatgcgtgcatacactcacacacaactaagaatcactaggtagctaaatttgaaattagatatcaatacttctcacttgccagaccctgaagaagtgagtaaacttctctgaacttatctgggaaatccaaacatctacctggcctcctgtagaaacaaactttcttcgtaaagagtaatttggtaaacacactgggctttgggagccccagggtctctgtcacaaccactcaactctgctgtgatcatgtgaaagcagacatggacagtacaaaacaactagcatgactatgtcccaataaagttttatttacagaaacaggtgacagctccactgactgtagtttgctgaactccgccatacaccattgtgaaagtaacatggcaaaattctagtgatgatattattgctatcatcattatcatcatcatcatcaatgcccttcactgcttagaaagcactcccatttgaccctcccaatcacagaggcaggagcaaacactactcaggatgttttataactaaggaaggcaagttcacaagaagctaaggcttcagccatggggtgggtggacgtaactgagagcagccttcagctcccctgaccattaggcgtctcctctcttcactcagagagcttgggaagcctcggcccattgtacatttatttgtaagggataattttcatgtcattacactgtcctcactactcccagagagaaggtaaaccttctcattgctggggtaaaaaaatgctatgggaaaaatagaaaagcttttatttatattattgtaagcttttaaaaatgattttgcctgaataggctatattcctcttttctgtctgattattaccatttttatttcccagttgtaaaaatatatgtttgccatttgtttgaagaacaatgcaactctctccaatccatcacatagctctgctcttagcaattctcacagctcatcaggaaaatgattgcctgattaaacaggcgtgactaagccacagcatcctcagaatgtgcatggagcccttggccctgagtgcatcttactccagcaatgccaagcatcgcctgacgcacagtgcaaagagcaagaccaaaggggagttttcaaaagaaggaaatcatgtattttatgaccagcagcatttgtaaaagctattttccaagtaattatgtgaattgattttgggaaggcaatatgattctttcagcttgatgattcaacgaaatgaaaaccttcagagggagaaaaaaaatgatcaggtaatctttctcctgaccacgattcatgctgtgttatctcaggctccaatgaagtgcttattgtgcacaaaatgccctctaataatttcttttaaaacattcattgtcaaattagcaaagcagcagtcgacagttgagtcttacaacctagagttcaatactgagaagtggggttgagtcgaatcctatctctgctcactgtgacttcagatgcaagctacttatattctaagactcagtttctccatctgttaaatgggacaaaatagaaactgccttgtgtggttaacgtatagatatgcagttgaccctgagagaggagagggctggagagtgagttaataatcaatcatggttacatgacgaagcctccctacaaatccctaaactaaagggttgggagagcttccaggctagtgaagtcatggaagagctgggagagcggcactcctggagagagcatgaagctccacacccctccccaacacctcgccctgcgcgtctcttccatctgactttttatctgtatcccttgttaataacctttattataaaccagtaaacataagtaaatgtttccctgagtgttgtgagccattataccaaattatcaaacatgaggaggtgattggaggaacctctaatttatagccagtgggtcagaagcacaggtgacaacctggagcttgtaattgtcatctgatgtcggggaaagtcttgtggaattcaacccttaacctgtggggtctgtgccaactatgggaagttagtgtcataatagagtaagtaatagaacacccattggtgtccaccaagaattggagaattggttggtgcggggaaaaaacccacacattggtatcagaagttgtatgagtgtcaagaaaacagtattcttcttttactgtcaattctctgaactgtccatccactttctccttgaattcctgcaatctgatgtcatcaaagaattgtcttgatactcattttgttcagaaccactcatactttttgtcactaaccaacttaccttgctatcttactggttttgaactctgagcatttcttgtcagctgagtcctgctgctatgtctgaatgtatcccccaaaattcataggctggaaacttaatccccaatgcaacagtgtcgggggcgggggggggggaacttttgggaggtgtttaggtcttgggggctccatcctcatgagtggattaatgctgctatgaaaagggctttggctaaagcaattgtgacaaaaacaaaaattaacaaatgggacctaattaaactaaagagcttctacacagcaaaagaaacgatccacaaagttaacagacaatctacagaatggaataaaatatttgctatgcatccggcaaaagtctaatatccagaatctttaaagaacctaaacatattaacaagcaaaaaacaaacaaccccattaaaaaatggacaaaggacatgaacacttctaaaaagaagatttacatgcaggcaggcaataagcatatgcaaaaaaaaaatgctcaacatcattaatcattagagaaatgcaaatcaaaaccacaatgagataccatctcacaccagtaagaatggctactattaaaaagtcaaaaaaaataatagatgctggccaggtgtggtggctcaagcctgtaatcccagcactttgggagtccaaggcaggtggatcacttgaggtaaggagttcaagaccagcctggccaacatggtgaaaccccgtctctactaaaaatgcaaacattagctgggcgtggtggtgggagcctgtaatcctagctacttgggaagctgaggcagaagaattgcttaaacccgggaggcaaaggttgcagtgagccgagatcatgccactgcatttcagcctgggtgacagagcgaaatcccgtctcaaaaaataaataaataaataataaaaaataagggatgctggcgaggttacagagaaaagagaatgcttatatactgctggtgttaatgtaaattagttcagccattgtgaaaagcagagtggcaatttctcaaagaacttaaaacagaattaccatttgacccaggaatcccattattgggtatatttccaaaggaatacaaatcattctaccataaagacacatgcatgtgtatgttcattgcagcactattcacaatagcaaagacatggaattaacctaaatgcccatcaacagtagactggataaagaaaatatacaccatggaatattataaaaccataaaaaagaatgagatcatgtcctttgcagcaacatggttggagctggaggccattattctaagtgaactaacccaggaacagaaaaccaaatactgcatgttctcacttataagtggaagctaaatgattagaacacatgggcatgaagaagggaacaataggcaccaggggccgggcgtggtggctcacacctgtaatcccagcactttgggaggccaaggtgggcagatcatctgagatcaggagttcaagaccagcttggccaacatggcaaaaccccatatctagtaaaaatacaaaaatcagctgggcgtggaggcacatgcctgtagtcccagctacttggggggctgaggcacgagaatcacttgaatccaggaggcagaggttgccgtgagccaagatcgctccactgcactccagcctgggtgacagagcaagaccctgtctgaaaaaaaaaaaaaaaaaaatagacacgagggcctacttgagggtggaagatgagaggagagagaggattgaaaaactacctatcagatagtatgtttattatctgggcaatgaagtaattttgtataccaaccccccatgacacgcaatttacctatataacaaacttgcacttgtacccctgaacctaaactaaaagtaaaaaaaagaaaagaaatcacgcctgaaaaagggggctgctttggggagtgggttcactcttccactctctgccatatgaagacagacttcctctcttgcctttccaccttccatcgtgtgatgacacactaagaaggcccacacaagatgccaacaccttgatcttggacttcccagcctccagaactgtaagaaataaatttttgctctttataaactacccagcctgtggtatcctgttataggagcaccaaacagactaaaacaccagccttaaaatatatttgtcattcatttatccatcctactcaggttttttaataaggaattttttgatatctagtgcattatattgccaaaactaaaaccaaaatcaagtcaaataagaaattaaaatgtctctactaatgacccatctgctttctgatcttacttctatttctccacatgtttccccacaaccagaaagtctcctaagtggccccatggtcactcaggatcacttttattctcagaatccaaatttcttccctgcctagaatttctactttctttccttccacctagcccagggtttctcatcctcagcactactgacattttttttttgagactgagtcttgctctgtcgcccaggctggagtgcagtggcacaatctcggctcactgcaagctccgtctcccgggttcatgccattctcctgcctcagcctcccaagtagctgggactactggcgcccgccaccacgcctggctaattttttgtgtttttagtagagacggggtttcaccatgttagccaacatggtctcgacctcctgaccttgtgatctgcccgcctcggcctcccaaagtgctgggattactggcgtgagccacagcgcccagccccactactgacatttttgcaggagaattctttgttgagtgagaggaagctgtcctgtgtattgcagaatgctgagcagtgtccctggcctctacccactggattccagcagcacccttcctatttgtggcaaacatgaacgcctccaggcgctgccaagtagcccctggagggtaaaatggcccttggctgagagccacagtattcatatgcaatattatcaataatatgtcattaatattaatattaattaatgtgcaatatattctaacctgagaggtcaaacggtacaacttagcactatagcactgcgtatattactgtcctattattccatgtttttccaaattcacttcacaatcattttgtttcttaactcacctcgcatagcatgaggcacagagcagggactcaataatattcatgtgctgtgaccaaagggaaaatgtcagttccatgcttttagaaaatttggtcaaaagactcagtgtgtgtacattgacagagacaactcggtcagtgggcataggagtgtgagaacattcagattagttgtttgattaaaactaaatctgctggctgggcacagtgactcaagcctgtaatcccaacactttgggaggccaaggtgggcagatcacctgaggccaggagttcaagacaagcctggccaacatggcaaaaccccatctctactaaaattacaaaaattagctgggcatgttgacacacacctgtaatcccagctactcaggaggctgagataggagaatcgcttgaacctgggaggcggaagttgcagcgagctgagatcgctccattgcactccagcctgggtgacagagagactccatctcaaaaaaaaaaaaacaaacctaaatctgctaagtgatcatatcctatagtgagctttaaactaccaattttaataatttaatgattctaaaattgcaaattaataaattatgttcgatccacttgagaaactgatttggctggcttttagactttaatcaaattttaaatagcattccaaagtgttagaaatatttcttctcttttttgcaaagacaaattggctgatgaaaatcagtggctttaggtcactcaggagcaattaatcaacagatatttgaataaacgtcattaaatgacaatacataaaatgtgattaagacataatgattatcagtaatcataagagtggataaatggttttaaaatgtcaatttatgacattcagttatattgtaagaacaatcctttgatgcattttctgtttgtatctatatttatactggcaatataaatttgacattagataattcctgaaatatcttaatatttaaacagacaattatgcttatcaatgttttcatttaaactaaatcacactttttgaaacattgctgaatatgtgattatacttctcttttaacttttgtttataaaatagagggcgttattccttagcattagacttgaagtacttgtgttagtctcaagtatttccaatagttctcatcgttttaaaaagttaccttctcagtactgatcttgcaaatgttagcaggtttttgaggcatttgagttgcaaggacttacatcttagtataaattcatcatggctaaattcttcattcttcctcaagtgtccacacaatatccaacatcctgatgtaaagtaaaaacgttaatcatcactcaatcagtttcatgtatctacatgtttggcgccacagacaaaacgtgattaccagaagttttccttctccctttgacccgatgctccagtgtcacactaatacagcaaaggaggaagatagtgttatgggagaggagaaaaatgaagctagtcttatttgttgagacatcttgcagttacgtgagcaccaaagaaaaggagacatccaaaatcatgcacaattctatcaccaaaggaagaattcaaggtggtatttccttctcagtgtcccatgactgacttactcacacatctctcttatcccaggccaccaccatgctctgataaattgtctgcattgggttgtggcttttctcttgttttgagcctgtttttctatgaccgtgtttgaaacgagctctagaatcccatcagcaagtctagtttggatgagatctatcctagctgtccttccaaaagttgaaattcatgagcatccctagatctgtgtgcatctgattcgtattttaggttggtgcaaaattaattgtggtttttgccattacttttaatagggtttagaaatcatttaagatcctttaaaccctttgctctgggaccaaggtagactcaggatctgactaacaaagttgttctagatttctgctttcctaggcagctgctcaaaaaaattaacaagggtcaatctctttgcctgagagtcaacaggacctacggtggaatcagcgaaacagggttaaatggaaagggcacagagccccaacctcacacacaggtacctgttctgactcacccagtactcagtgcgtagttcacggcaacatgagtgcctgctcatagctgtaaaaataagagagaacatgggtaaacagctgatcgatatcaggttccttagatataaaacatgaaccacaataataattcctacttcatggggatgacctgaggcttgaattagagtatttatttgagcatcatacttagaagtgtcaaccactgtgaagggtctgagattttagcaaacaagttagcttgccacagattcagggatgctggcagaagacacgaaattcctgggtcagagacaaatgactctactactcacagcaatatcagcggccagagtatcatcaattaagcctattcctcaatctccaatttcaagaggcaatgcaaaggccatgtgacccctgcacacacagtgcattacattacaggagagagaaactgagtatattataataggcagtacacctgcctgatctttgccctggagagagacattatctctacaatactgcagagtaagcaaacaaatctgctgcatgctctagacagagacactatctcatcttccaaactgtaatggacataaacaccaagatagtctggaataaaatggcattttgtgccacatttgcaggacatgctgaaacacagaaaacctttggagagttattaatatttcccaataagaagtcagtagatctccactcattttcctttccttgctcttgccatttctcttgcctggagttttctccttgtccccttcacagatccaaagtctttacttcagtcttcctcaggctttcaccatggcaggacaagaggatctggtgcagcaggagattcagtaggactgggcgaactgggagtacattgagataatcaccagcagcatcaagaaaactgcagactttctcaactcgttcaatatgtcttattcaagatttgcaacactaagggagaaattgacagcccttgaacagagaatagagtacattgaagcatgggtgacaaaaggtgagatgcttacctagaacagtgccatgctgctgctgggaagttgctttacagaacacaggccacgtgagaaaggccccagcagccttctgttccttcctttctccttaaagagcaacagggcttattcttgtttttccttttcaaaagtgtggcctttgggttcttccatgtacatctgagggtgtgatgtggtatatgaggaaaagtctagaggaactcttggaaacaacattaggtattttacctttccagtaacattttgtagaattacttgtcaatgtatttgagacattcacagccaaaagcctgggattctttgtgaaggtcctccccacccctatccttctttctctctcagactttccttaaagttctcattgcctctgcactgcttctgtgaacagtctttgtctcctccccacctttggtgggaagtgtgaggcagtcctggccaagacactcatgctctggcaatgtggctaccagagaatgctgttgctaatccgccggtttcctgttgatttggggaggtcgaggccaggctcccacttggcttaaagggacattttcagacatttctttctgtcacttggggtgtctatgcctctcaaatttccctaataaactcctcaacttgatctgactgctgtgattatggtagggacaggacctagagatgggttcacttattccacagtaatgtaatgtatgggattattattccaacaaaactttcagatgtagctgtttgattcaaagcctaagtggcttaccagcccaagcccccatgtttggactttcagctgattagtttatcctaggaatcatttggtcattcagcacatttatcaagtacttaccatgtaggcatgttatactccaataaaagatacatcattgaatcagagaaaaaagtctttgcttcattcaaagcacaaatccaatgtccattccttgaggagcctttgcaaacactgcagtcattataaatcccttcgcagagttcctacttccatttgtagtctgtctcattaaaacaagtcattttttgacttgttcaatgcttctcctactttttaaaaactttaaattgagggacttattgtaaggagttgtagtagatgctagttgtgtcccatctatagccccttagcctcatgagtggccagctcattacctgagggctctatctagtgactcgaatgtgcacctgcaggcctgaagagctagggaattaagctccaccccccagcagccctcaaccagtggcagatggaagctggtgtatcaatgccccagctcctttgttccttgggtacgtgcatgctcctgactcctagagttcccgtggggcattaagctccatttatcctcagtggaacctggcttgatgacagaccctttggtgggtgccctccctttcctgtcttgttttccccctccccacccagtgttttctgagaagaccagctccccaaaaatctagttgcactaaatcatacagcttttactcgcaattactgtcatatcaattatgaggcatcaagtccaattccatcataaatatttgaaaatcatccttatgttcccaaagaataaaataatcatgatattacagttataatatcactgaaataacgtttggagctaaatgaatctatgtgtgaaggcaacaaaaatatcagcagccagagatgcatttggccccagaatgtgtctgaaatgctgcttggcatctgagaatgacttagaagtgcctttccagcagtccagcgtgggatgagatgtaactagaggggctttgagaatacacagaggacactcaagtgctacagggaaagtggcaaaggtcaactgcttctttttcgaggactttacttgctcccgctccatcctgatatacaccctgagtttttgacgacatgacattctgatggggaactgcccctagccctatcattgtggcatgatttgtggcttttttctccctggtagtcaaaagtggatagctggcttcttgagtcacgagttgtgctgtcatccatgcttgtagtaggagtaacaggggcatgttaactggtgtgcatagatcccccttgaggtgtgagaggagtcacggtcctggggggatttaggatggggcccctttcctgaggagatcagcgcaaccccaaaaggaaacacagcatcaaacattttaaaggcacgatgacaaggcaacaaaaacacctgccaccaggattctgcgcaggatcctgtcatgcttccccatcatgtctggattgacaccaggtcgcaagactgtttctatcatcaaatacaacgtagaatccattcactgaacaggtcatggaagatagcccatggattctttccccaccattgccctgaaactcacaggaatgcatgccacctggccactgcaacccgtcaagaacgggttacaggagggggccttggcagagaaggcaactgtttcgctctgctctcttactaaatgcactaaagccactcttgctataattagtccccaaagagaaactaaagtaatgggaaagtggaagcttccttgctaagaccctagggatctctactgaactccagtgttactgaactctagaaaggatacgactcaccttgctctttcaaaggcaatcgtgtctgacatatcatctaggaattgtttctttgatgtctcatgtgtcctttaccctgttgcatctgcaaaatgcatgcacacactttatccaggaaaagacagttttgagggatttttttttatcctagaagtattgacctttttcaagttcacttacaaaaattaagcaacttagtgtcagattatctagaaagacatagaaagcagaaggaaaataaatcagtggacctaaaatactattactattacagtaaggaatgtgaaactttaaaataggtaaattcaaatgtgacccataaatcagggtcctcagtgtacaaaaccaaaacccttcacactgtggatactggtccaggacaggcgcactcaaagagatttgggaagagtgaagatgcctaggatgtaggaaagctacaaagaaagagaccattctgggcatgaagctagctggagaaaatgatcactgcatttaacagaatgtgggtgtactctgcaaataggtactatattaaggaatttcataggtaaaaggtaattaaatatcagcttgagtcttatatctgagctcaatcaagagggaaaaaaggttccacaatctcagaacaggattctcctgagtgggaaacacaccccctctgaaggaaaaatgttccctgctgccagcaccacccccgggtagcagaactatctgagtttgaggtctggaagtcctcatctccagcagagagccactatacgatggccctgccctggccctcaggcctcctaggtgcgcgggagtctgtgggagaggatggttggggagagcctggtgggccccatgcaaaccactcaaagtctcctgggtgccaggaagaaagctttctctcagctccgtcctgtacgtggtaatgttaacagccgctatcatgctttcagggtagcccaattcatgcatgtacccaacccacccccatttttctccttcactctaaaactggcactgatgagctactatttgacttagtggtgtagcagagttcccagccaactgcttcaaccatcccatccacttgggtctctgtggttgctgctggctgatgttccccaaggctatttcttcttctttctggggccacaggtggactatgtttcctagcctctcttgcagtctcttgtggctacgtcaaaagaacaatagtacaagagaaaggtcagtgtggaagagaaagtaccagtggatggttaaatgtttgctattctgagctttactggaaccacaaggaaagagtgttctttggatgaaaattctaggagacacaagagggctaagcttcacacaagctcacgtctaattccagtcctgcccctggccactcaaaggacattgggcatgtcatgctttctcatcagaaacatgagggaattacattggatgggctccaagttttatcccaacatcaaaatgccatgatgtgtctgtggcttggttattcctcctagccactagcacacggttgctatttactctcctgatgattcaacttcaatttgattttgcagtacactttcacacttccacatcttttccaaggtgcttctgtatacattgccttacatcccatccaacagctctgtaaaataagaaacagaggaggctggcacaccatttagagatggggaagctgatgtggcaaaatcaccagcctatccagaattatcaaatactagaggcagagctgcagtcagaactccattctcctgactactggttttcttctcattcttgttcactatgtcacattcagttcctgcaaaaaaattggtcactaatgttgctttattaaattagttcttaagcattaataatcgggggcattgcaatttattctattctcactgtaaacatgtaaaatgatgcaaatgaaaaaaaagacagactcccaaaaatatgttcctaaaaactttttgaggaacataattttcatcattgaggcaaagctgcattgacacgtattattcatagaagagctggagatgatgagaggttggggttcacattaaacatatgtgtaatataggttccaacccaaagtgccttttttttctgcaaaagaactcaggtcttcatttgggaacatcaaaatacacatatgtgagtcatctctcacatatttccaatccaatgggcacgttattgggttatgcaaggcatgcagtacgtttctatggtaaattgcaaaccaagaactttgactgatgtcttctttttaaccagttattaagaaaatttctctgtgcacccattaggaaagctataataaaaaagacagtaataaacgttggtgaggatgtggagaaattgggaccctaatagattgctgctggtgggaatgtaaaatggtgcagctgctttggaaaaagtctggcagttcctcaaaaagttaaacacatagttaccatggaacccaagtatgccactcctaggtatacacccaggagaaatgaaagcatatgtccccacaaaaacctgtatacaaatgttcatagcagcattattcataatagccaagaagtggaaacagcccaaatgtccatgaactgatgaatgaataaacaaaatatggtctagcatacagtagaatattatttgttaataaaaagaagtgacattctgatccatgccacaacctgggtgaaccttgaaaacatgatgctcagtgaaagaaccagacacagaagaccacatattgcatgattccatttcaaggagaggcccagaataagtaaattcagagacagaaaatagattagttgggttgggagaagggagtaatgaggggtcatggctaatgagtatgaggtttctttttggggtgaggaagatattctggaattagattattataatggtcgtgcatctctgtaaataatgaatgtcaaatgcttagcacaatacctagcacatgcttggcattataagggataatacaatagtaactttattacaaccataatatagtaataatattatttttaaaattttattatagttacagctgtgaataatctcatgacctccaagcatgaacaaaacctcttttcctggtttcctttcactcaaatcaaccaagtagggcccatagtttccataggccaaatgtgaccccatgcctgtttttatagatgcagttttattggcactcattcatgcctactggctactactgcttatggctgctccagtgccacaaaggcatcactggatagtttcaacaaagacaaatgcttgaggtgatggatatcctataactctgatatgattatgacactgtgtatacttgtatcaaaatatcacatgaacctcaagaatatatacaattcatatttatccataataattaaatataaaatatttgtaagcctaaatactatctgaacctatgcagagtcattttgctgatcactctgttctgtgatattcagaatattgtcatttttatcctgagagagcacatattacaatccttcgagagaagccaagaaacaaacacattagctgagacagggtgcagcgagcactccctgggactcgcagggctgggctttgctccttctcctctgtgcccctgcccttccccagacaccattgacacatatgtgcccactaggcctgataaaagcacaggtcaatcaaggaaacctccgtgtaggctaacagcgctattgaggctttactctcctaactcatgtggacagttagggtttaagaaaacaatattgttgggggaatatgatctgtcctagaatgctagccatggctatttgatgtcaacccgcattccaactcctactgctccaaaaacgaagtcagtgttccatcagtccacatgagtctttgcccatcgcccccagcacccgtgtcagaagctgttttcaaaagtgattttcatgtgtcccatgtcagggttgtcacctaccaccacagaatatgtttcactctactaacataccgtgggaattgacgcctgtgttttttaagttgattagggtttttttctttctttctttctttccttccttctttcttcgaagaagaaggaggacgacaaaagaaagaaaaaagaagagaaaaggaacagtgagaagggagggaagcaggaatggagaaaggagagaatcagcaagattatttcttcacacgtctgtcgcccactccctcatggggctcccaccgcctgtccagtgagctgtgtgccacactgcgtggaagagaggggcatcgagacaactgcatgtaaactttcttaaaggaaagaaacgcaggcgcagaggaagagaagcttttttgccttttccaaagaaccagacaataaatccagatcggcacatcaaaatcaaagatgactgcagcttcaaagcttcccgggaagatcaaaggcgaagcgtgaagaaggcaggcaggatctctgaggataggaggaggccttctcggcccttgtggagctctgtttcaacaaaccagaatctcccgtaagtcagctcccacgtttaaaatcagctccgagccttgcacagggagctttagggaaagcttcttcacggaaacaaaaatgaggcgttttagcaataacacagaaatcaaactctcctggcagaaagcttccaggcaaactccttgccctaactccctaaaaagattgtcttgccatacctcgcttttttgctgcaacctccccaagtgctggaaaacagaacaagtattagccccacgtagcttaaattcttagaatttgattactgatttctgtataattggtcggaaattgcctctacctctctctgctgctgttataaaatatttcttcctttaactcatgtttgccagaacacttgtgctgtgtaatcacagagatagtcctgtaatatccgagtgtggcagtgaattggattccacataattagttgaacataattgagcaataatgtgtagttatggaggaaatttactggacctcacacaaaggaaaatttctagagcagtggcgtgttgttcccgaagtaattgtgcaaagcatcacctacagtactgactctgtcttttctgctccggaaacatcattaacacgcctacctctacagcaacattctctacgctgtccttctctttctgcagagtggccgatttcagagtggtcgtaagggaacaaatcagtaactctcaagatcacaggatgtctttggcacctaacatataggtgtccaataaaaagctattttcaaaattatttattaaaaaactcactgaaactgttctttcatagagaaaacacaagacacacatatttctaatatcattatctccttatctagatttttcccgtatgtaaaatagctgttttccactgctttagggactgtacaactacatgctcttaaaaatagctccagatagctgagcagcactttccagctgaatagaaaacatcattagtaaaacctaggtccaaattctgatgcctataaatgtttttccagcatttcccacaccttgattcctgcagaatccacaagcctaaggcaacagatgcacacacatgcatgtgcacaaacacacatgctgtaaatacaaaaagccaaaaccaccttataaagtgtttgcacttattaatgtattgaatcttgtcaaatcacatcaagccttccatttcttccacacctaaatgccacctacatctatcttttaccctatttgaaaagactgtggaaaaaaaatccgcaaatctgtaaataagcaaataaggctatatataagtgtttcttattttatttattcattgtgtactgatacattcaagctaattctattcagcacacccaaggtgcctaaagcattaactttttctgaaaggctaagctgcccctaaacgtttgatcctgatgtttgttcccctgaaacaggttaatgagtatttaaaaaaaacccaaaaactggctgatttttaatgcaaccagcttcacaaaaacagatggcgtatgacctgcctaattagataacacagatagaatctcattccctgaacaaagctgcctcttgagtaagcctgctacatatcacgtatcccagccataaaaatgagtctgtcaagtgggtttttccccctgaatatcatcaatcatgttatttctggtttcttctcttgtccctcacctgcctccaggctctatcttcctgttttgatctacattgacaaatttgagaaaagatgggcaaatgccaaagtttggcactaactcttaacattaaaatagctgaaaatttgaaaactttcccaaatgaacatttttttcactgccaagaaagtccatggagatatatttgttctccacactgtagtcttgtgtggctaagaggatgggttttgaatgaccacaccaagatatcaaatcaactctttagttcatcccatctctcctcataaaaacacacacaaagagttgtcgtaggccatcaatccatcaatccccccatcagggagggatccagccatacctgcttattctccaagattatcttatggataattattgggctgtgtcaccaaacccacccccaccaaaaacacatacatgtgcgcgcacacacacacacacacacacacatctaattttctgaaacaagaaggcctaaaccaatgatgagaagaagaaacatttgtcagtagcagttttatagactacagtctttggttcctttcatgtctttttggaaatagctagaaatgaaggtggtgggggagtctatttctgggccactaacaccttcaatcctgaatctttcatgacacaaagagaaacattgaaaatatagctgcagcaaggatttaatggaattcctgggtgagggagtcaggatacaggtgtgtaggtttatttttccagttttaatatggaagaaagggaatggcttgtttcctccattgcttaacattgatgaatccttctgtctccaaattagtttccctattgagactgagagcacatggaagggctacaacttgttttcatcctttttatccccaactctcgggagagtgttaagcagagggggtgcttcatgattgcttctttctataagtgtggtgtttacggatgccttgggacccgacgtggcttcaccgtgcatccttttttcacacacacacacactgagatcaccactgccctcctccagctgctgctctcagttacacaaacactgagatccctgccttcctccagctgctgctcttatttacacaaacatcgaggtcaccgccctcctctagctattgttcccggggccatacaatcatccacgttcagggtttaattttactaggtgataaaaatggattgcaatgcctgtctggggatgctgtttgacccattttatcaagtctctgtgactgtgttcattaaattcatgcatgatcaccgttcagtaatgttccagtaagatctggggagggagccgccacagcagtgtcacagtttccaaaggtccccacatctccacagaaacacagacagaatgagcagttagtaaaaccacacatgcagcagattcacagcaaaatcaggtgaagagcaacctgcaagccttgcaggatcagtgtctgtgtgggaggaagcaggggaaacatcagggattctggcagacccaaaaacagaagaacctggaaacagccaataggcttgtgctggaaagcatagtgggcccatgtgagaatagcagtggaaattgagaggagtctcattgaactcaacagacatccccgccagtctgaaggggcagggggagctctctggcccccacacgcctttggagctgacaccgggttcccttctaggcagggccctcacactgcaagtagaatccaagctaagcagggcagggacaagagaaacaaagggaagagaatctccagcagactcataatcttgtaaaatctacatgaaaacaacacaacagtgaggtcagtaagattaaaatgctactcaacacaactacttctaatgcttcaggaaaactaactttatgtgaaaatgaacaatggaaaaggatcatgcttgaatctgactcaaatttattataagaaatgaaagaagaaagagcagagtaacatctccacagacaagaaaagcatgccagaagatacatttttataaatcacttgaaaactgtaattttctgtttcgaagagagctaaaaaatactcatagaaatgacatacaacattaaaatacaacacaaatcagaaactgaaatactcagaaatcacaacgcagaattcaagacaatgagaaataagaaaaataatctcagaaataaagagtaaactagaaaaaatatgagagagaacacattaaaaataacaagaaaaataaaaggtacaaaaaggaagaaaatttaaaattaaaaaaagttgaagatacaaaaagtatttgaaagaaagcgacaagtatttaaatgagcaaagaacattgaacgtgttgacaatagaaatccctgaaagaaaacccaaccagggcaacaagtaccaaaaactataattcaagaaaattttgcaaaatagggatttgaaatgacatatggaaagagcaactaacatccctgagaccactgacccagaaaactgacatgaagatgttatctactaaaatgtctgaactttaaaggaaaagaatcctgtgggtttacaggcaaaaatagaaagtgacacataacttaaataaatttacatcattatcagacttgaacagcgaggcttttttttccagtagaaaatggagtaatatatttaagacagggtccgcaacccctgcacagtggaccagtactggtccgtggcctgttaggaaccgggccacacagcagaagatgagcgacaagcgagccagcattactgcctgagctctgccctctgtcagatcagcggcggcattagattcccacaggagcacaaaccctggtgtgaactgtgcatgcgagggatctaggttgcacgttccctgtgaggctctaatgcctgattatgtgaagtggaacagtttcattcagaaaccatccctcccgccccaccccattcatggaaaaattgtcttctacaaaatcagtccctggtgtcaaaatggttggggaccgctgatttaagatacccaaggaaggaacccgtgtccaagttctttatattgagcgaaattggccttcaagcacaaagagcacaaacttaaagatgtaagaagccagggaatgttttttcccaagagcccttcagaaggcgtctgccagacaatgagttacagaaaaccagaatgattgactagagagacacagacctaaggctggtgttgagcattaaatatatgacttgcacacaaaaactaaccgggagttaaaaggaagagagcataacatgcaatggctatacactcagaccatgtgaaaaacagcacaaccatgaaaaatggggaaagattgaagacaacagagttaaaaaattttctgaactgtttttggtaaccattttggtggtgatggtagcatttgtatcattattttgagacagttatgtgtgtggtgcaagataaaacaaatgaggaattatgcaatattttaattctagccttcccagtgttctggagaatgcggatccttggtgttggaaagggagattaaaatttcacatagagacaagtattactgtaaactcataaactacgtcgccttaaaaaaatttccagcccttaggccaggcgtggtggctcacgcctgtaatcctagcactctgggaggctgaggcaggcagatcacaaggtcaggagatcaagaccatcctggctaacatggtgaaatcccgtctctactaaaactacaaaaaaaaaaattagctgtgtgtggtggcagatgcctgtagtcccagctactcgggaggctgaggcaggagaatggcgtgaacccgggaggcggagcttgcagtgagccgagatcaggccactgcactccagcctggatgacagagcaagactccatctcaaagaaaaaaaaaaaaaatttccagctctttcccccacaatttcctggaaacaatggctacccaatggcaatgaacatccctagcaccaagattatgttcttgaaatatcatttcccagtgaaataccccaatgaattttggagaaatggtcagtttctagcctggagctagaatatgtacaagataacatcaaagatcttatagaagatatcaagaaaaccatcaatgactgctctgtgtcaaaaggactcaaaatccaataggaagagactctcactgaccatgatgggacaaactgaagttcaataatgataagaactgcaatggattgaaacgtatttatttaaaatcaggagtttgtgattaaatttttaaaaattaattggtccctttctgaggattataagaaatcaatccattatcttgaagactagtaaataaaactaaagaattaagcttctatcctgcctttcccacaggaattacatcactgggcaacacagagtagatgagaagtgacgcctagtaacattattgcagctaataaatgcgaacaacatgatagagtcagaatatcaccattttgcaacttccagtgaattaacagatctaggcagctgctaacatcacaaaatgagtacaactcagttaccattatggctcctgaggagagaactcaacactgcctcatgttgccaacaaattgactctaaatctggtcaagcctctacatctagctgcgggaaatacagagaacacaggaaaatattcagctgcaccataagtaagcaatcacaaatgtccaaactttgacaaactcgacaggtccaatgccctagctttttcaacaggtaaattgtaaagaacaatacagcagcataaaggaatggaggagagcactgtacattaaaagcctttaaaagatccaactatacaagttggcagaacctatagtgtctagggatacatatcttagagaaagaactacacagaaatgcaagaaaacaattgctataaaagttaacatagtgggtacacagcaagatagaagggatatgaccaggacggggcacatgaatggggcttctacagtatctgccaatgttctttcttatgaccggggtgatatttacaagggtgcttgccacagaatcataaattaacctatgcacatttgtgtcgttttccttttttttttttttttttttttttttttttttttttgagacagggtcatcccgtgttgcccaggctgtagttcagtggcgtgatcatagctcactgcagccttcacctcctgggctcaagtgatactctcagcctctcaagtagatgaaactacaggtacatgccactatgccccagctaattattttattcctattttttagaggcagggtctcactgtgttactcagctggtctcaaactactggcctcaggtaatcctcagcctcccaaagtgttgggattacaggctcaagccaccacactgagccagttttgtatagttttctgttcctttgttttattttacagtgaaaagcttagttaaaaaggtagaaaattaataatgcttcaagttatcaaagaatagggacaatcatataaaggaaagaatccaacaggatagctgaagctctggagagaggacagcatggagctcctaactgcaggagtcagggccagggactccagggatctgagtacggctgtgctattaaagagctcagaaggcccaagtcctgagccaggtatgctggactaagagggaacacctggcatcggcaagagacatcgttaaggaaagcaccacgattcagctccacaggggtggatcccaagacacaaaccaccagtcacagacaggcaggctgaagaaagagaactcagcagaaaagtcccaactatctggctccacctcatccatcaccagacaccagcagtatctacgagataaagataggctgcaagaagaaaaacactttaaaaaaggaaatgacagcggccgggcgcagtggctcatgcctgtaatcccagcactttgggaggccaaggcgagcggatcatgaggtcaagagattgagaccatcctggccaacatggtgaaactctgtctctactaaaaatacaaaggatgagttcatgtcctttgcagggacatggatgaagctggaaaccatcattctcagcaaactatcacaagaacagaaaaccaaacaccacatgttctcactcataagtgggagttgtacaaggagaacacatggacatagggaggggaacatcacacaccgaggcctgtcgtggggcggggggctaggggagggataacattaggagaaatacctaatgtaggtgatgggttgatgggtgccgcaaaccaccatggcacgtgtatacctatgcagcaaaactgcacattctgcacatgtaccacagaacttaaagttaaaaaaaaaaaaaattagcatgcacctgtagtcccagctactcgggaggctgaggcaggagaatcactttaacccaggaggcagaggttgcagtgagccgaaatggcaccactgcctccagcctgggcaacagagcgagactccgtctcaaaaaaaaaaaaaaaaaacaaaaaaaaaactgaaagagcactttggaaaataagggattttttaaaagaatgataataatttttccctgaaatacatgtttctgaaaacttttccagagggacccaagatgaacattattttctggacctattctaaaacattttcactttcttcttcccaattcagatgatgtgccttatgcatcaccttggatcctcttggcctctctgtccctgaggaagtcactcctggtgagtagtggatccataagtatgaaggctttacctgtggctgccagagtggagacatgggtgggagatagtgttctgagggggcacagtgatatttataaggacaaagtgaaggatgccgttggaagttttgcaaaaaaatatataggctcagggtagttaaccaccaatttatgacactcatctccagcaaccacagggcaagcagatggtgctaaaaagaagatccagggtttcatttaacaggtagcagagctgcaaaaaagactgaacatgcagtctgacttctaagtcaaagccagagctctgctgaagaaaggatgggactctgagacacaggaggggatttttacttggaccagcctaagaatggtaagccccctccatccccccaggcactctgagcacccagaagcagctccactcctctgtggccagaatagacctgcacctccttgtttggagacctcaaaatggctacacctgaagtggctgtcttatcagatgataccattcttctttatattggcaggtcgccaaaacctctgcagagtcctccaaggctccctccacctgggcccccacgcagtcatctgtgtgttggggaggggctgggcagcacgagtcagggctgctcctcaaagtcaccaaggtggagagtcaccaagaaggagagtcaccaaggtcactctacctctatgcatacctcttctccccttcctggagccctagccaatattgtctaggttttaggagagctgtctctcctcaacccccaaatattcccacattttccgtctagaatgagtcctctattctccctagcatcttagcctcctagaaaccaaagccaacaggaaaccctcccgttattttctgctttctgcactgaggccacaggttcacgagaacctcactgcttaagcatgggaaaggacagataagggaacaatcaggagggaataaatagaacttcaaaaaatattaacacatcactgtaaaaataaatagaaaaatggtgcaggcataaatgagtccaagagagggacataactccctgtcaaagcaagattctatatgaaaacatctaatcctccacattggccaggttgcaaatcactatttgcaatctatcttaaaataggatgtagtaaaagcaaaattgaaagagacagaaaaacctcctcgcgcaacttaacgcaactttgattccttcctggcaacttttgaaaggctctttcaaataacacagaccccaattcctctgattattacctggctccatggaaaaacctgggtgcaatcatccgttaggtgaatttttttatcaacctgttttaaaagcttgccaaaactcaccactgaaagggttttctaataccatagctggacacgtatctctgtccataaacaaacacccttattgggaaatgattttcatccgccgcatataaatgcacatctttatcctgtaaatcagaatccttgtcacgcaatcattttgcatttaaattctcctcccagaacaacagtatcccagggaggtatacacagtatctttaaacttaagtgtcagcctgaacatagacttcacatcaggcctattttcttaatgccccaaaatacaaaatacaaatctcattttagattcattaatctgctcatagccaaaaaagcaaccatccaacagctattaattaaaagatattttagggcaatccagatgccttcaatcaagtattgtagctgcttagagttgcattaaattagtttatcttcagtccaaagtttcacttcatccatgaaacaatgtaagttgatcccttaaaaaataaaataaaataaaatagaagtgggaggcttcccaactgttttcgtgaatgtgcttaccatctggagaattcttcttctatgttcgccaccactttaatcaccttgcctaataaacaggcgtgattgatcagagctgaaagacagaccacttccgttcaaggacccaaaggcatcattcagtgatgatgtgcctgagagtggctggaaggcacacattcccaggcagccaaacaattgtgagcttcacagccctaataaaatagaaaattagagacacaattttaatgtagatatcagtgtgcattcaagctgttttttaaaaataggaaataaatcgtatttattagtcacacttgacaactgtctgaaaatggtccaggatgcagcaaatctcagcaaagctacctcatagtcaccaaacatatatgaccagcagccaacaacaataaacactgtacttagggctgacaacagctgaaacccagccatcctgcctgccaagctattttatgtgtttcattctcgaagttggattatctgttatcttcatatgtcatttttatgaaataaactaaagaatgggtttaagtatattatatgcaatggatatgaaagaaaattaaatctgtatgtcttcaaaagagatatatatgatccaggtggatatcctacgtatcatatatatatatgatatatattatatatataatgtgaatgcttctaaattttgttttcaacattccaaaacctgacttatcattttgcttaatttaaaatggtttacacatgcatcactatttgtttggatacggtgtgaatctaggtactaggcaccaaaaaaatactaaaagaaccaaaatgttccttcagtacaaacacaagccgggtctcaaaaataattttcaatgcaagggacaaagagctttcccacatctggccttatgagcagaattctcatacctgagccctttcctatcggaaattcaaggttctcctaccttctcacgcacttctatgcacatgggtaaggcggcttcagtgataaaaatcaagagactcatctccactatggacagaggtggcttgggaaaagaaaacccatcatgctggtgaaggcgtagtcagaggcttgacaagcgataagcacctgtaggtagactacatagtggaatactaaactgaatggccatataaagtcaacagatttggtgaatatttcctgctgatacccacgggttgacagtgggcccttgtttctccctagctatccttccaagagcattgctttcttttattctgtgttacccaaccaggctgaattttttccccttcctgtctccttcttacatgccaaaggtttgggtcttcagatgctatttccttgccaacatcctgtttgggttattgataaagaagctggatattggaaagctctcacctttgaaatagttctcaggctatagttttgcaaactgcggagcgcacacctttcaatatttatgctccttctatcgacactgagtaaattagaatgtggaatacctgcaacatccaaaccatctgcttcactgcattttaaaaaagagtaggtgaagaaaatttatgagcatttcctcttatgtgttgttgctagggaaacaacttttttttttttttttttcttaagcacggatgattctagcatctcaaaagaaccagggcacaatctttcttcccctctttcttcaaatgaaataaacatcttccctgggcagttttctcctctgtcacactggccactcattttccaaggatgttatatgattccaagcaagtcagaaatactgactgaatagggctgaatttttgctgtgttttcacagttggcctgtgccaaacagagtagtccacaaagtttgcctcgtgaaacaaaatgcccattttcactaggtgtgttttataaggtgctattttgtcgtttgtgcacagaagactctggagaaatacaaagatccgtcctgcccatcaaactggaaatcgttttcctgaaagaaccccttgtgtgatgaagacaaaataaaaaataatgatgttcagttccatggagctttctgcctgaaaacataaaagggaatccaccagcagagtgggaaactgcccacggttttcatatcttcaggggccctggaacatatcactcctccatgtaggcagcctacattttaccataggagagaacaccctaaaaaggcttctgaaatatggcgtttgcgtatggtagatttgcttgtttctctgcagcatcaattgctagtggcacattttgtactagaaaggccattgtgcccagaacggaaaacgactgtgaaccacctagtgatttgcattctgcttttggggataatcggacccccctaccggccaaaatccacatcacatttgcataattcacttttgaaacgctgtgtttcattctcttgagcccacagctgctgtgcggggaactggcgtggtccacatccagcttcagattctctcctacataatccccaaagcagagaagttttgcacgcagtgaagcaaggggacgctgatgttcaacagggacagactttctgtcttatgcttaggtgtgacctaccagaaagcaaccaaagaaagagtcaatgatcctagctgggatggcaaaaagaagtaagaattgaatttggattacaaatggtcgacaaaaataatgttcttaccaaaaaaacaaaaaacgaggcaatggtaaaatcaatgagcttatctttctgatatagaaaataacaggatgattgttaatacatgttcaggaatctaagaaaatgtttcatataggcctatcatgtagcatttttatttgcataattatagtcaacatatgattctccatataggggtctctcattgagaatgtttcttgtgtacccatagaaaagcctctttggtagattttccggtttataattatttaatcagaagatacacgggaagttcttttgtatgtacctgtagaatacatcccagtaagtgtcctatggagaaagacctgttgtcagcaataaccttcattattctaactgtgaaacattcattaatgcgaataatattctcaaaggttttctacaatgagaatcatccagtaaagctttttacttgagaatttaaaagttgtaaagttgttagttaaatgtgtataattatcaaaacaggttgactttggaaaacaaactgaatttgctaagggaaggaaaacttgaaaataatcatcttagatgtggaatacaatttgacctaagcaattgtttcaaaactgtcttcagtttcttgaaaataattgttagggctgatatgaaatgaaatacatatcaaaaccgtcttcagtttcttgaaaataattgttagggctgatatgatatgaaatacatatctaggccaggcacggcgactcatgcctgcaatcccagcactttgggaggctgaggcggattgatcacgaggtcaagagatcgagaccatcctggtcaacatggtgaaaccccgtctctactaaaaatacaaaaattagctgggcgtagtgctgtgtgcctgtagtcccagctactcaggaggctgaggcaggagaatcacttgagccccggaggcggaggttgcagtgagccgagatcagccaccgcactccagcctggtcaacagagcgagactccatctcaaaaaaaaagaaaaaaagaaatacatatctaatgttacagattttggtttattggttaattactatgtattttttcagtttaaaaaataatcttattttatatacttctctcagtataatttttcatgacatttcagcatgttgatgtgtgcatctatttcagtgccttaaagtattttgagagcaatcttttgctgacagttgaagaactgttaagaatgaaatactattcattaaatcaaaaaaaaaaaaaaaaaaacaaatggccgaggaaagagacctctgcctcaacccctctatttagcaaagcaggaaattagtataaaaggggccttaaagttcaaatgtaattttttttttcttttagttagagacagggtctctctctgtggcccaggctggagtgcagtggtgcaatcatagctgcagcctccaacttctgagctcaagcaattctcccacctcagcctcccaagtagctgggaccacaggtgtgtatgtgctaccacacctggctaatttttttttttttttttttttttgcagagacgggggtctcggtctcactatattgcccaggcttgtctcgaactcctggcctcaagcaatcctctgccttggcttcccaaaacactgggattacaggcaggagccaccatgcctgacttcaaatgcaatttttactgttagaaaaacttcatattagcatgatccgtttcacaacagatgccaactataaccaacacagtccaagactcatgtttacagtttattagcttgtttgccttcctttaggtaccatcagcaaaattagataagtgtgcagaaattatcatcgtgaaccagaagactcaatgatatgcatcagaacaactcaatgtgtggtccttgggccagtagcagtggcaccaaccgggagcttgttagaaatgcatattctcaggtcccaccctagaccaagaggaccagaataatgggctggtgcccatgtatcagtatttagcaagttccctaggtgaggctggcacacactcaagtctgagaaccactggcttgagttgtgagggccctacacactacaaaacctccaatgtcctcacttgtagcactaattaactatttgtgagttattgtttagacaaattagttatacacacatatatctctttctattgcacttcacagatactgcattttttacaaattgaaggtttctggcaaccctgcatcaagcaagtctattggcaccatttttccaacagcatgtgctcactttgtgtctctgtgtcacattttggaaattctcacagtatttcaattcaaactgtttcattactattatatctgttatcctaatctgtaatcagtgatctctgatgttattattgtaattatgttggggtaccatgaactccaccaataggagatggtaaacttaattgataatgttgtgtgcgtgtgttctgattgctccacagatcagccatccctccccctctcctcagccctccctatttcctgagacacaacaatatgttgaaattaggacaattactaatcctccaatggcgtctaagtgttcatgtgaagggaagaatcacatgtctcttactttaaataaaaagctagcaacaattaagctcaagcttagtgaggaaggcatgttgaaagctgagacaggccaaaagctgggcctcttggaccggtacaccacgttgtgaatgcaaaggaaaagttcttgaaggaaattaaaagtgctactccagggaacacaggaatgataagaaagtgaaacagccttgttgctgatatggagaaagtttgagtggtctggatagaagatcaaactagtcacaacattcccttaaaccaaagctaatccagagcgagggcctaacttttcaattctatgaaggctaagaggtgaggaagctgcagaagaaaagctggaagctagcaggggttcatgagatttgaggaaagaagccatcgtcctaatataaacgtgcaatgtgctgcagcaagtgctgatggagaggctgcagcaagttctccaggttctccagaagacctagggtaacatcactaatgaaggtggctacactaaacgacagattttcgatgtaaatgaaacagctttctattgggaggaaatgccgtctagacttgcatagctacagaaaagtcaatgccgggcctcaaaacttcaaaggacagactgactctcttgctagaggctaatgcagctggtgactttaaatcgaagccaacactcagttgccatctccaaagtcctagggctctaaagaatgatgctaaatctactccgcctgtgctctagaaatcgaacaacaaagcctgggtgacagcacatctgtttacagcatggtttactgaatattttaagcccattgttgaaacctgctgcttaaaaaaagaaaaaagattcttttcaaaatatgattgctaattgataatgcacctggtcatgcaagagttctgatggagatgtacaaggttagtgttgttttcacgcctgctaacacaacatccattctgcagcccatggatcaaggagacattttgactttgaagtcctatcatttaagaagtacatttcataaggatatagctgccatagatagtgattcctctgacggatctaggcaaagttaattgaaaacctgctggaaaagattagccattctagatatcattaagaacattcgtgattcatgggaggaagtcaaaataccaacattaacaggagtttggaagactttgattccaaccctcatggatgaattcaaggggttcaagatgtcagtgaaggaagtaactgcagatgtggtggaaatagcaagagaactagaattagaagtggggcctaaaggtgggactgaattgctgcagcctcatgatcaaatctggatggatgagaagttgcttcttatggatgagtagagaaagtggttttatgagatgcactctactcctggtaaagatgctgtgaacattgtagaaatgacaacaaaggatttagactattacatgaacttaggtgataaagcagaggcaagatttgagaggattgactccaattttaaaagaagttctgctgcgggtgaaacgctgtcaagtagcatcatatgttacagaaaaatctttcatgaaagtagcgtcaactgatgcagtgaaatgcattgttgtcttattttaagaaattgccacagccaccccagcctcctgcaaccacccctctgatcagtcagcagtcatcaacgtaaaagcaagaccctccaccagtaaaaaaaaaaaatgatgacttgctgaaggctcagatgaccattagcatttttagcaataaattattttttaattaaggtaatgacattgtattttcatacagaatgcagttgcactcttaatagactatagtataaggtaaacataacttttatatgcactgggaaaccaaaaagttcgtgtgactcactttgttgggctattcactttattgtggtggtctggaactgaatatgcaatctctccaaggtaccgtattttatttctggtaccattatgatccagctagatcacaaaaatacaggccacattagccaaaatcctatttaatatgcattaactttataagtcataatttactgaatccttgaagcagacacagaacagaaggaaatattaaggggaaaggtagaataaaatatttaagaaatgatgttgccattaaatatattgtttgaaatgaatatgtaaaaatatgaagaaagacattataatattaaacttaaaattcagaatacagaactgtatattcagtgtaatcacaaccttagaatgcagattttttaaaattcaaagattggaaacagattcactaaaatgttagcagtcaatatctttaggtgatggagataatagaggattttgttcatctagaacttgctgatgcaaagataaagatcatcagtgttcatggccaagtttttactccagttgacatactccagaaatgaagcaaagctgagtcactcctgggtttgctattaacaaatagacacagtgctatcattttacgagaccatcctgtgaagcatattacacatattaggaaatgatcttaacaggtgagaaatgctctgaaaatatacacgtagagtgcaaggaatcatgtacgtgcccaaatgggttccactaaaagggaagactcgttcagaattgagacaaccatacaatacattcatcctttcctgttctctgttctaggtctcctccaccatctaagagtgacagacagttcaggagatcttagggacccaattcttaaaccaagtgatttcctgaccagttccctagctatagatatgcctctgcctaaaactttcccagttgcttcaaattttgagatcccagaaaagcagatgtccaacagatattcagaaggatagaaaatgttgttccctcaaatgctgacttaaccttgcagtgtcctttggctgccctgaaggagatccctaaagaattcttcataaatacaacgacactgctttcatatgacactggcagcttcaggttgtaaataacaggaagcaccaaggggtcactgatgagaagagcctctgctttacactcaggcaggacaaggctgaggtccagggtctgttactctgggtccagtcctgaccaagtttcatccatcggagagcaattaaaggagaaaaaaaaaaaaagggtaaagaaataacaaaagtaatagcagctacagcaaaatgaagagttgcaaataatttctgtcttagtccattcaggctgctctaacaaaacaccatagactaacaacagacattaatcgctcacagttcttggggctggaaccctaagatcaaggcaccagcagatattgtgtctggtgaggactcacttcctggttcatagatgcgtgttggagccatagtgcaccctcgctctgtcctcacagggtggaagggcaagggagctctctgggtactcatctcgttcacaacgctccaccctcatgacctcagcagctcccaaaggcccacctcctgacaccatcaccttgggggttagatttcaacatgaattttggagagacacacattcagtctctagcaatgtccaatccatggagaaagagcaatacagagaaaggatgatccatgggagtttgagaagtaaagaaataaccagcaccaagttcatgatacaagaaacaccaggaggaacaccgagcagggaaccctgtgctctgggcaggcgacagagctccatgtgaacttattctgttctttgaagatttctcactcaggttaacacctagacttcacacttaggtgtgaatgtcacttttaaagacattcacctccacattttcaccttcttcttttggaagagaaagacgaaaaaaagaaaaagatctttgcattctaaaagatactttgtcactgcctgaaaaaataaacggctgctccaaagtagtaataaatattttttcatttactgagcagctgctatatgccccagaccctgtggagtgcttttgtttatgagctcatttaagtcttgaggcaggggctctctgcttcgctttatggatgagacggagaagccagcatatagacgaggtcttttctaaggtgtcagtcatatctggctgaattatctgatgcctgagcccatttctgtatctgccccacaccgtgggttcccactccagccgacttcatcaatattctggacgatgcgaacagcatcctaggactacccttgctgcgtggcttcttctctcctttaatcaaaggtgccaggggcccaaacctgaaattgcaagggaaggaaacagtaaaagcagtaactacctcatctcttagctctggtaaatcgtcttatttctctcaactgtagtatcacaaatgcacgctccatggttttagcaagtcttggactctcagtagaaaacacatgcccaaacaatacatgttaattaacacaggtgctgattgctttgtcattcaagaaaggggagtcgcttcttttaatcagtgtgatgagaatcgccaaggctaaatgcagtttgctgaggctctgagatgtcttgaaggattatataattcccctacaaagtgagaatgctagaatgtcagaatcaccctgagggctttaaaacatcttggtgcccagggcacacccaaaaccataagatcacaatgtttagtcaggcaaggagtgggagccaggctcccctagatgattccgggctggccaagaaactggggcagtaatgaaataacgtgaggtaataagtggaaaagagctgatgaattttcaggtgattttcatttacactgaggaaatgtaaccaagttgggaggaaaaaaatcaatgatctctatgtcctaatgatactgaaaattttaaattttcaatatagtattatacacacctagaactcagggaaaaaagaagaggcttcgtccaattatgatattcttctctccctttctgtttcagttctggccctagagcaaaaatgtctgcgagggcgttctgccctttgtgatttgtaaaaggcaccgaggcgcagcccggaggagacagcgcaccctgaccctccccgccgcctccgccacttccccggggatgttggtatctttggaactagctgattttgaactttatcttccctttgaatgactgtgctatcgctattatttttccaaagagaacagagcccttccaaaaatggtttaggttcctggaaaagaaaaataaccattttctccaacatttacattacaaattacatttcaaacctaatgggaaagtctgtttattttttattcaaattacgtcaactcctttccagaaacaaattaaactcgtttcctactcagctgaaaaaaaaaaaaaaacttcaaaacaaaccagggagatgctacgcataaagatctaaatgtagcctcattatatatctgctccaccaccccatatttaataaagatatggtttgatacatacttatacattatatatagtgatatactaaaatatggatatttatacataatacttataatatgtaacagctattttataggtataaaatatataaagcatatttctattatagatattatatataaatatacatacatgtaatatacaattatatataatatatgttatatggttgtaaacggatatatagaaaatatgttatctggttatctgcatgtaactggataatatatacatgtaactgtatgtttatcatatacaaatatacatataatacattaaatatatttatagtttatgtatctttcatatattatttcatttatatagatatgttagcctggccaacatggtgaaaccccatctctactaaaaatacaaaaaattagcagggcatggtggcatgtgcatgtagtcccagctgctcaggaggctgagtcatgagaatcgcttgaacccgggaggcggagattgcagtgagccgagattgcaccactgccctccagcctgggtgacagagagagaccctgtttccaaaaaaaaaaaaaagatatgttaatgtgtgtgtattgatactaaacataccacatatccaaaatgattctaaacaatgaaatttagcatataaagccgggcacagtggctcacgcctgtaatcccagcactttgggaggccgaggcgggcagatcacgaggtcaggagatcgagaccatcctggctaacacggtgaaaccccgtctctactaaaaatacaaaaaattagccgggtgtggtggcaggcgcctgtagtcccagctacttgggaggctgaggcaggagaatggcgtgaacccgggaggcggagcttgcagtgagccgagatcaccccactgcactacagcctgggcaacagagcgagactccatctcaaaaaaaaaaaaaaagaaagaaatttagcatataaactcagaaaattactttctgggcagagacaaagctaattcaatcttaatttgatctattactttaagatgatgattgagtgtactaaccaatacaaaagaggttaacaaaaagtacctgaggaagatcagttttgcaggatttcagagtattattcaccaaatctgctaagggtatgttatttaaatccatcaaaatcccatttctggggttctaggtaaatgtaaggtgtggctccagcaagctccatctgaggctagagtactaaaagccccccaaggaagacacactatcagacaacagtagggaaagcagaaatacctcccatagccaggctatgtccattccattggtgcttgactactgtctggattcattcgatcacgttaatttacttgacaagttatgtttctggtaggcttcaagaattatcttgaatttgaaactagtggggtagaaatttaaaagctttcccaatgctttctggacatttccgcctcgtattttcccctgtggttagagctgatgctggcttacctggggacacccaggtacccactgatgtttgctgatgctagtattgatcctccaaaccagccaataagacctctcttaggagcttctatcaccaacaggcactctgtctaaaactgcgacatctcccagcctgaacaacctggacttttcctcttgcctctcttgactatctaacatgctgtatctttcacatatttattttgcagatttttcaacactcctattagactataattttgagctggttgttcattggtaaattgcaaatgcttataacagtgcctagcaaacaccggatgatcaatacatatttgtcaatgacatgaatcaatcggaatgcaggcagattgatcaagataaaaaggcaagagagtaagaggaaaagggggaaaaatagatcttgacaactttcaagtggttcagcacccaagtcaatttgttttcagggtgaaactgaatctcaatgtttctttcaaacacgtggactatttcttagtcatctcaataagaattttctggaagactcgggcttagatgtaacaggttcaatggacccaactgccctcggctcttgccagaatgagaaacactttggttttgttcaattcatttatttcctgcactcgaattgccatcaagagatgtaaatgttgaaactgatttgattttaaatatacccacacttctcggcctcttgccaacccttttataatcagctcctaaacagcctttgcaacccacactcagttgtgtatgtttttgttcaacttactttacagattggcagaatgtcgtgttctacttattttccaagttgtgtatgtttttgttccacttatttcaccccattacccagggcaggtccttctgtaaagcccaaacagtgaatatttcaggttgtgcaggccacacagtctctggggcagctactgactctgctgctgtagcccaaatacaagccatacgtaaacatgtggttatggctgagctcgaataaatcttcatttttggacactgaaatgtgacttttatataattttcacatttcaggaaatattatcttctgattttttccaaccattttaaaatgccaaagccattcttagcctgtgggccatacagaaacaggcagtaagcagggctgtcacttgtgaacctaagtttgcctaaagtcttaaaaagatcacttgaagtggttcttaaccttcaaatctggtgcttttcggatccttctttcaatctctattccataaatgcaagttgccacaggaaaggtctcttccgacacaaagactaaagctgcagaatgagccagattcttaccagaggacttaagtttcatgtgttcgttgctttcagctctttagggctgttaagccaacacctatatataatcctgactttaaaatattagcaggtgaccagggagatgttagcaacatcattcctcatctcccctagaaatgttcaatgttccttcccctgggctcccagggcttttgttcatctctgtctcaagaaatcctgaaacatgtgtagccccttgagggtagagtcgatctaagccttattcaaagtgtagcccaaccctagcatcccgttcagcaccaaagacgctcagtgcctgcttgttgaatgctgtttcctcaccttaatcagaaatgggagagtatccctgagtgtggagctgagtgaagagcaaaggcagctttctgaggcatatttcattgggaacacacacaatatgatttgtctgtttgggagggtctctgagatttatgtctattggattggagaaagaaaatcttttctacatcctcacctacttggagaacacattcactgatctaagaggctggatggaatgggcagctcttggcaaaggtaaaatgcacagttatcttatgaaataactggccaggcacagtggctcacgcctgtaatcctagcactttgggaggccgatgtgggcagatcatttgaggtcaggagttcgagaccagcccggccaacatggtgaaatcccgtctctactaaaaatacaaaaaaattagctgggcatggtggcacctgcttgtagtcctagctacttggggggctgaggcagaagaattgcttaaacctagaagacagaggttgcagtgagccaagatcgtgccaccgcactccagcctggatgacagagcacaactccgtctcccccgcaaaaaggaaataaccatggcttcacttcctctcttctctcctccctatagtctgccattaccattttccaagggccccaagccccagctgctagcgatgtatggaagtgtcagacatgttttagttgctactgctcatactatcatctgcaggtagaccctgagatgatctcgagggaagtgaaccccaatactagcctcttcaaagcagcatttgccccaacaggaagactctttggccaatcaaacgcaggtgttgttggaatggaattgttcctgcaatgccctctcttcacctcttcctcctgctaaaactgtcctttccttcctctttactcaaggtgggtcactgcattgagcatgcacggaaaaagggcttggggttttctccaaatacattttgaactggaaaattaagctatatttattttgcctcttaaatgggttagaagaaaaatcactgagtagatcccagcattggccaattgcttagtgctgcatgcagatttgtggagatattggtggactccataggttgtgaccttcccgtcgcttatgaattgcatatcgcatcagagcagaactcccaggggcttccatgtcaagaagtaccaagaagtgctgccagggatgggctgttctgcctcacaattgtgatgaacagtctaagatggccccaaattccaaccacctgtcctgcaatgatacatgatcccctccccttgacatacccaagacgggatgcaccccataaatgcataaaaacattatgtgtctatttttaaaagttaacctgggccaaaagaaagaaaaactgcaattgaaaagcttctaaaagttgtttttggtgctaaaaatggacacagcatgatgacgttttttaatgagggcaccagtccatgggtgtttttggttattcaagtgtgggtctgcccctaggttgaggagcatgatgaggcacaggcatctggagtgtggggtagcaaagtaagagtgctccatactgcgctagttttctattgctgtgtaacgaatcaccacatagtgacatcgcacagcacagatttattatcttacaatttccgtgggtcaggttatctgagtcctctgctcagggtctcaccaagccacaagcaaggtgtcagctgggctatggtcttatctaaggttcatagtcctcttttaagcttacatggctgttggcagaattcagatctttgtggttgcagtactgaggccccatctcttgctggctgtcagctgggagcttctcacagatcctagaagctgcccacagttccttgccatgtggtcccctccacaagcctcctcacccttcccaccactctgacctcagggagtagccagttccttttaagctgtcacctgattaggtcagatccacctaggtcatcgtccttttgattgactcaatgtgaacagaattagtcacctaatcacaggagtgacttcgatcccaggttctgttcacactcaaggggagtgggttatatggggtgtgcacagcacggggcacaatattgaggaccatcttagaattctgccacacatacagagcctagggaaggggaaacacaagggaaagaaacagtttcatgcatgggtccatttctgttcagaagacagtacaatgcctggccttagtaaataggaaacttttttcaagtaatgagggtggaggctgtgtgaaagaggtggaaccaacttttgcatatactcgaagccaggcaggatattggagctaatacagtaagcctcaggaaactgaccacttgcttggttctgttcaaagtgtggcccataaactggtccatcagcatcgcccaggagcatgtaagagacatacatcttcagaagccccacctcagacctgcccagttagaatttctggggtggtactcaattatctcttttaacaagttttctgggtgattcaagtgcacccagtttgaaaagaatggcgttagccaaccctgtaagttcggtttttttccaacaaatattaagcatctacacagcactcacaaggatcttaactttgagacaagaattcagtgcacttaaaagagataaataacttgccaaacacacaaaagtctgaagatcaaggttatagatgaatggacccttaagaagaatggtctgaccccagggcaggctatcctttaggcttctgagcagctgaatgttctcacacgtaccgacaagcatctgccactatcgactctgaaagaagccacatacaaactctgccttgatactagcacagccgaaggggaatggaaacttttgtcaatttgatgatttgagtattttaagaacagaagttcagctattcagcccatccaatgaatccggtaaaagtagatcctgaagataatccctaagtactactcaatggaaaaaaattgtgctgttgggactgcattggcacacaacagttctgtgaacatctcacagcagcagaagcccaagacagaagcagtgtagcctggtggttaggagttcaggcgctggcatgttgcaaacctggggtggaattccagctctcctacccgccagcctctctaagtttcagctcttctcgtctacacaaatgggacaagaccagtgccatcctcatttagtgaggatccaataattcaggcaccattcaacaattaaaaggcaaatagtccaattaaaagtgggcaagggatttgaaaagacattttctacaaattgccactgatgtacaaattgccattaagtgcatgaaaagatgctcatcatcattagtaatcagggaaagacaaatcaaaaccacaatgagacagcatttcatacccactaaggtggttataatgaaacaacagacaataacaagtgttggtgaggatgtggagaaaccaggaccatcatatactaccgataggaatgtaaaatcatgcagccactttggaaaatggtttggtggttccacaaaatgttaaacatagtggttgagtcagctcaggcagctctaacacaataccacagactgggtggcttaaacatacatttatttctcacacttctggaggttgggaagtccaagatcaaggtgccaccatgctcaagttctagtgagggctctcctcctggtttgcagacagacaccttcttgctgtgtcttcacatggcagagagagagcatctttctagtgtcttttcaaaggcattaatgccactcatgagggcttcaccctgatggcctaactacctcccaaaggctccacctccaattaccatctcactgggggttggagcttcaaaatattaattttagcgagacccattcagtccacagcaacacagaattaccatatgattcatatatatccaagagaattggaaacacatgtctatacaaaacccatatatggatattcattcacagaaacattatttatcatagccaaaacatgaaacaaaccaaatatccatcagctgatgaatggatagacaaaatgagttctattcatacaatggaatataattcacccacaaaaaggaataaagtattgatacttgctacaacataaataaacctcacaaacattactctacatgaagaaagtcagtcacaagaaaacatatattgtatgattccatttgtatgaaatgtccagaataggcaaatctatagagacaaaaagattagggttgccaggggctgggagaagaggagaatgtgagtcactgctaagggaaatattctggaattagattgattatagcaagactttgtagatatactaaaaaccattgttttagacattgaatttatggtgtgtaacttttatgtcaattttttaaagtagaaaaatccacatagattgaccttgtcagtttccctgacacatagaaaatacatacaagttatcataacaaaataatgagatgtggagaaatgtaaaatggtgcagccactgtgaaaaactatatggtggtccttcaaaaaattaaacatagaattaccatgtgatccagaaattctacttctggttacatacccaaaagaatggaaagcaggaacttgaacagacatttgtattctcatgatgataacagctttattcacaaaacagctaaaaaatagaagcaacccaagtgtccatgaagggacgaatggataaacaaaatgtgatatagacatacaatggactatttcgcttttcaaatgaaggaaatgctggcacatgctacaacgtggatgcaacttaaagacattatgctaagtgaaattgaccagacacaaaatgacacatattgtatgtttctactcatgtgaggtacttaaagtagacaaattcatagaggtaaaaagtagaatggtggttgtcaggggctcaggggacagaggaatgagaatttattgtttaatgggacagagtttcagtttggaggctggaagaactctgagatggatggcgatgatggctgcacaacaatgtgaatgtaactcatgccacagaactgcacacttaaaaatggttaacatggtaaattttatattataagtattaaaccacaattaaaatgtttttaatagagcattgtagatagaggctataaaacaatgcctttgtaaattaataatcaagcaataataaaatgattattatatgttcctgtctttaaaaatgaaatgggaattacatattccttcactgtagtggactgaggataacaatgcatgaggataacatgaacctccaggttcagagagaggaaaatgaccaaggaagccttttcaggactcactgatggtctctgctttctggggagcaattcatatgccatcttagctctgaaatatttgcacaccatctcttcagaggcagcatctgagctgcgttccctgaagagatgccttgggtatctctggagctaaatcaggctaaacccagaagcaatcatcactgaggtgttgcttttcagagaacaaatggccacctgtatactagagacattttgaaaggctagggagagcggtccaatttgaggttaatgaagtctttgaaaagataaccataccttgtcaagaagatgctaaatctttgcataataattactttcctgacatatccaactttagtctcattcctacttttactttttcatcctaacgatgcttttcctaatggaatttgtcgtgatttttcttcatagaatttttatgtggccagcctggtaatcatttttattcctcatcaaataatttcagaaaaacactatgcatgcagaacaatataatgataacgatcatttaaagtattcagggaaatcctaaaatccccaagaggaaaatataattatataagagttctgctgtagtgttgttaagttttatttcaccagacgcgtaatacctctttggtttgatttcatacctcatctcatacctctagagaaatttgtgtgtcggggggtgggggggcggggaggggaaaaaaaaaaaatctcttatgatgcacacctgctgcttattatttcaatttctcataaaaattgtagtgtttactctattagcatcacaaaagcagtgtaaagaccaataaatagtgaatatctgtagcagataatacatatacaatgaaaaaccacaacttaaattgttttctctacttcacagcaagaatataatatgtttcaacaaatttcttcactgattaaataaagtatctgcattatatggatgtgatataaggagatttttaaaataggatttaacttctagttaaacatggccaatttaacctatggatttctctctaaggagttacataaatcccttacggggattccaaagcttgctctgagggtagccaggcaccatgtcatgaggacactcaggcatccatgtggagagcccaaatagaaaggaaccaggttgccaacaccaagttgtgagggtgccatcttagaaatgtattcctcggccccagtcaagcctttatatgattgcagccccagatgacacctgactgacaacttaggagcaaccacaagccagaactgtcacattgagctactactgaattcctgaccaatagaaaccttgaaaaatgataatagattattgtagctttaagccactaggtttggggtgatttgttccacagtagtagataactaatagaagtgttttcttcattctcattaggaacttcctgaaatgtgtctcttatctactgcgttaaaactcattaacaaatttctattttcaacatattaagtccaaacttcccttcattttctataatttggagcctactttaattctcaccactccacctatgctgcaatgtagcacagatatgatttcaagaattagccattattcctcaattagcctctatgaaactagcatggacttggcagtcagagagtcctgggtcctaattcaaaatccacttcttgtttgcctatctatatttgccattttcccagaagaggccactgcatgaagagtggaacacaacccacgacaagaaggaagaaaagcaccattaggatcaaaaagtaaaagtaggaataagactaaagttggctatgtcggttagctattgctgtgtaacaagttaccccaaaagttagcaacttaaaacaacgcacacttattatctcactaagcatcagcccaagatttgtgatcccatatgaagacttgactgaggaatgacctgattctgagtttgtgtgatcattagcaggactcagttcctcgcaggcaataagactgagtctcaaagtcatcaatagtggcaaagtctgctagccagataaatattacagccctttgcatcctaatcaacaggatggcatctcaccacttttatcatattctattggtaaaaagcaagtcactaagtcaatccacactcaaggtttggtggggaggtggggcaggttacacaagggcataaatatcaggaggtgggaatcactgagggccgtcttagaagtctgcccaccatggtttggatacataaaataacctacatattcactttaatggcctggtgtttaagaatacagaccctggagctagactgcctgagttcaaatcccagttctgccacttttaagcctgtataaccttacggaggttactcaacagaacctacgtcacaacaaagttcacaatgtccacaggctaaaaataaaactaattcaattgtacttttagtgcaatagtaggaaacagtaggaaaagtactattcttagtactaagactttacaaaaagttctccccagcacaccatgggtaatggaagcaacagcattttccagaacagcttcacagtaaacactacaatgaatttctgtagaccacttgatagaactaaccttaatctaaaccaatggcacccaccaaagttcaacgtgacatgagcaattcttggaatagtcagaaaaatcagatctacagcctagctcacccttgatcggatttgacctcactgatttcagaatatttgaaagaacagagagctggcatgttcttcatgtaattctccctaaaaaccatttctttcaacagatatttcgatgaagactaagtagctgtaaattcgaaactgtatttcctggtataaggattcaggtaatttatacacataagatatatattttttaatttcctgtacaaagcaatctaataagacattttgatgaagactaagtagtcataagttcaaaattgtattctctggtataaggattcaggtaatttacaggcaaaaagtaatctaataaatattaaatataaatattaaaggtcttgttgttttctgttgctggttgaaaacaagccccagtcttgatctgaattagggccctaccacttactggcttactctatgaccttggtcaagacttgtctgagcttcagggttttcaacttggaaaatgaaataataataatgtcatcatattgggtcgctaggagaattaaatgagattgtgtttgcaaattgcataacatgatacttggctcaaaataagctttcaaaaaaatggtaaaaatccttaaatattatttttaactggaaagtctccttataccacaagtttatgaatcttagggctggttgatttgatcactgttcagcaaatattcattcttttccctgcctcaccacagcccaccacccaaacctccatggcggagtgtacttccccagaccatagctatgtgactttctttaaaccatgcaagtggacagaggtgacagtgtacaaatgattctgaaccttggacttaaggggtatcatgcattccctttggaagctatgaacttctgccaggagaaacacaaacccgtctagtctgggccccaaataagacacatgcaacacagcttaacccaatttgcagcctggaagctggaacccagagcatagagtccaatttcgttcaggagaactatagctggtcttgaaactcataagtgttagaataattttatcttaagcccctgagtttcagggaaatttgttacatagtattactgtggcactaactgactgatgtactggataaagtcactttaacaactactctctgagacattgggcccctacctgccaaatgctaaaccctttgctattccctatgttgcatctctctgctagtccccaatgcagggggtgtcattatgtataatttgtgtctcattttacctatgtgctttccgtctgtttccgccatggctctcaatatcattctagatcagtctcaggtatcagttggtgaatgctttgttttgtttttttcttttaagtttttattttgacataatcatataatcacaggtagttgtgaaatagttcatagagtcttgtgtacatctcagccacctgttgccaatgatgacattttatataactagggtacaatatcaaaaccaggacacgaataaagcaaaagtgaaatatatatatttttacctgagctttacttagcagctatgcaatccttggtgagttacctattattactgaagctcagttttctcatccataaaatggggataataacccctactccaaaggtttgtgggagaattgagatagtgttcctagaacacctagaatggtactgagttaggcacagaagcggcaataaatggcagctctcgtgatttttctgtaggtttcacagtgaaaaacaaatagtaggttcccaagtcatatatactgatgcacaccttctctatgggatcaatagaataacactggatttttcttcaagagttccacaagacttgtcatcaatacttcaaggataaagaaaacataatgcagacactcaggaagaaaagacaagtaacctacaaaatagggttacacatctctgcagtgacactgaaagccagacagtaatggagcaatgagtacaatattctaaaggaaagaatgtgagactcacatgaaatccattcaagatatcatgccagcaaagagatggcagagaaagtatgaaatggttcagaaaaaccagcacccatgagccctcttgttaaaaaccgcttggaatgaaatccagacaaataggactctacagaactaaaacctcaagaatggagaatctttggtcaaacaatggagaaggagcagagaatccttttacataagactgatattaagcaattgtcagaattatggttaccaagcataacataaccgttatgtaaactatcacagtgtgaaaataatataagaatgaggaaaatcacaagggaaaatggagagaagtatgaaattactaacatcctcacatttcatagcagggagtcaatcaatattatctaaaattgaaactgtaattcaaagatatgtaatgtctccaacttcttaatgttactaatcatctcttcctttaaccttagaagcaatcttttaggagctaattaatatctcttacagaaaaaaaaatgtacatgaagtttagtgattctctcagttccatatcagtttcatttctttctgaagtaaagtaaaattaacgaagtaaagataatgataatactttcataaaactggatgaataacaaactactaaaataaaaacatggttttgtagaactatccgtccatctttacttccatccttcatcccggacacatactttggaaggtgctcaggacaaggatcatccagcactgatgacatttattcctcgtgggtgggaattccagctggtttttattttattttattttattttattatttgtatgtctctgtattgcttgatctttatcacaaggatgaattgttttaaaacaaggaataaagccgttgtgacttggcctctcatgggccgcctcttgcagcagtttgtctttctgttccaagtactgcttaaataatgtaaactggaaagagaagccagctttgatctgatttattcatgctgtccatttataaaaaccgaaggcagtggataaaggcccagccaacctgcttcttgttgcatataaacatagcaatagagagccgcaggaagggcagaggggaaggtgctcagccatcagtgtgggtgtgggtcctgtcttgagtcatcctctccctcccacccccacacactcttgaaagcccatctcagggtcttcatcaggacacacactaagagcgacacttgaatcatatcccagaaaaggtcaattctgagatcctgcctcaatctatttttctgcctctttggcttctcttccctctgaaacttggagcaaataagtatttctttctgataagttttttgttaattttcacatgaacaataacaaaaatccgtacattcaggaatttttgcaaggtgcctggtgctttcatcaataaaattcagttccaatttgtagccattatcaacaaaactggaacttccttggctgtggcaagaagggactgtttcccaccagctgctgagtcactggctgtagttctgtcaggtaagtgctcctggagcgagctgcagatgctgactgacacagaaaccagaaagcctcgctccatgcccctgatagattcaaacaaacacttgggcgtttagccagggggctgtgaaaggacactgccctgcataaaacccaaaaccggagttggtcgtggaaggctatgtgcttcaggcgattcagaatcttgtcgccagcgaaaaccctcagaaacctgctgagaaaaagatccactagaggacatgggccctccccacttttagagggtgagcagaaaaagtgggtccctctccacttttagtggccgagcaggaacctgcacagaagggaagctgaggcggtggatgcctgtgcttcctaacggcactgcctcagccagagggctcccatcatcagtcactttctcccattaccctctaaatgtgcagggtgacagtgctgcagatccctccccaaggtgcacgctggtcagccttgcccagctaatcacgtctctgtatggtagcgagagctgctcttggcccatctcagcccatatttctctagtacagcttgatgagcgttcatggcaccacacggtgctcagagcgtgtgtgtgtgggtgtgtgtgtgtgttctgacatcccttaaacaccactagtgttgctaacagggtgtgtgtttgtgtgtgatgtacttaggtctccttttctattaacacttgttaaaatactgttaagttcaaggcagaggaagtatttctgaattcaggttatttgtgaacactccgcacactccataagaaggcttcaattacacaagttaaaatttttttttaaatgacttcattaggctgggcacggtggctcacgcctataatcccagcactttgggaggccgaggtgagcagatcacaaggtcaggagatcaagaccatcctggctaacacggtgaaactccatctctactaaaaatacaaaaaattagccgggtgtggtggcaggcacctgtagtcccagctactcgggaggctgaggcaggagaatggcatgaacccaggaggcagagctttcagtgagccgagatcgcgccactgtactccagcatgggcaacagagcgagactccgtctcaaaaaaaaaaaaaaaaaaaaaaagacttcattataggcaattcatgcattcatgccccacctcaccctctgcatgaacccacaatgaccctatgaagtcacaatttagtgtaggtaatagacgaagaaaacagggattttgtttaatggagactcaaaacaccaacccttatggtcaataggtgaacagttagttctacatataaatgtgtgcatatctgagatgtacggagaatttctttttctgcttctttttcattacccttcactctttcctgggacctgcctctcaattgccctccagactccaagccttcaggctttcctctttcccggatggaagtctcatcccaaagaagaatttgaaaaatccattcatacgaagctctaaaagttcattaatgtaaatatttctaggagcttgttgcatatgcatccatcttctatattaaagcaatgagatcttttcagagcccagtcgacttttgtgtactgagaaaactcctcagaaaacattcgtggaattaggacaaaattccctctcccaggagtattcatattttagcaaagatgaaagcctcaaagccaagacaatgaaaccctaatggagagacattgaccagtaggcagaggaagcatttctgaatcagtgaagccttttgtagtcctccaaaagatgctacctaggtggccaccttcgttagtaattcattagcccaagtttcaagcaatctggtttattctttgatacgcggcagtaattctcaggacccatgtgttcggtaggatgaaaacgggtgttgcacagaataaaggaaactgtggtcacataattttggcacacacaaacaaaattaagcgggtgtttctactgaagactttctcgagtattaaatacactgaagtgtacttaggatcttcaagaggaaaacgcattccttgatgcttctccaagtcgatctctcttagcaccaagctccgagacacagatctttagcagtggttctagcatttagattcctggtggacataataattgtcttgagggctgtggcagccatagagttgcgtggctcgggtctttcccacctgctgtggggtgcgcggttggatcgcattgctcagatattgcaccttgattccacaacaatgttcttgccaagcccaagcttcccctgggctgctccaaccaatgacagacttcagcagcagcactagaactggccattcctctaatgcagggttcccagcctcagttctactgacattggaagctaggtaactttttgttttgggggctgtcctgtgcattgcgggatgtctagcagcatccctgggctctacccactcgatgctgagagcatcgtttcctgcaaggtataacaaccaaaagtatctccagactgcagagtgtccctgggagcagaattgccctaggctgagaccgtgtgttctaattggccatctcgacttgaggactcccccagcagcctagctaaaatgttgtccaatctacactgtagcctgaagttcttcctacaaagtcttccttactttctgctctcttttgacatgtgctgaccctgcatcactgccagctctcccaccttctgctgccccccatgcctttctccttcacagacatcatgtcctctaaaagatatgtgtacccagattctgtaaaagggaacttatttgaaacttctatgaaaaaccagagtgttttcatataaacatctcacacacaacacacataaatacacagacagacagaagacccagtagttgtaagatttttcattttgcagtttttaagtttcttaattggaatactagcttcagggtggagcccttcaaggaccaagaccaggaaacatgtagtttctagggcctaataagcaggcacatctggaaagcaaaacagatccccaaaaattaagggtcttatttttataccagttcctggatctcaacaagagggaatcagcccatctcccatggaaatcttatttctcagtggggggtggggacatttccataccttccaggtggccaaaagcatgcttctttgatccaaaaatgcaaagagttaagcatccctccataactgctgttaaccatcctcaaaagtacatttcttacttagctctttcataatgcaaagtaatttctgataccccccaaaagtcaaaaacatcaggcaatgcaatgcaaaacagagcagagccttagattttgagagggacctgtcagcttacagctcttggggttccaggaggaaaacagaggttttttccaaaacagggtctgtggcaccttttctgtttttcccaaagagtcccaggctgctagaaattactttaggtcctctcatgtgggcattgagaatggcaagaagacagactggggaaataattcagtcgactgaatagaaaaacaaacaaaaactttctctcagtggaaaaaaatcaagactttatttatttatttatttatttatttatttatttatttatttttgagacagggtctcactgttgtcacccaggctagaatccagtggtgtgatcatggctcactgcagcctcaacctcctgggctcaagcaatcctcccatctcagcctcccaagtagctaagaccacaggcacgtaccatcacacccagataatttttttgtatttttagtagaaatgaggtctcaccatgttgcccaggctggtggagggccctttaaaacacagatggctgggccctatccctaagcttctgagtcaatagatgtggaacagagcctgagggtttgcacttctaaaacatccccaggtggtgctcatgcttttgtttcacggaacacactttgagaaccactgaactacaggaaacccttgacaacacattcctctaaagaattcctggatccttcccagccttccagaataccaaaatgctctctctgaaaaaggtccctgagaccaccttttcttacccattctcattgtactgaagagggaactgagtcacagggaggtgagaggatgccttgcaaaatcaagcagatctcagatctggattttgagccagagtttgttgattcacgccaacacatctgcccacaaggcctgtccagctttctctatttcttctaatctcagtcctgcaaaatgtggctggtatcaattgccaatgcaaaagcagcagagcatcccacatcacaaagctagagtgcagtctccagtgggagaggacgccagggccccataactaggatcgtgggagtgaaacgggaactgctgtggagattaaaattgaacatacccgatagctcagttctgtcaccctgatatgtcaactgacaaaattcagcaaagagctccattttcatatatatagattataagattataacctatagattctttgcactttgaagtgcaaagaaattatccaatgtctaatctgaagatgtccctaaaccttaaatgttgcggcctctttttcaataaaaatatcagcactgagctttctgctctcaggaaggctgcagcttgttgtgtctaacacggaccagaattgacttgtttttttgttttgttttttttttttttgcctttcaagtgttgttgagtctacaaaatgtagaaagaaaatttgccagactttgttattgaattggccggcttcttagcattatctacgttgttccatttgaacagaataggaagaaggacgattttggacaaacatggcctaaaacacactgactcaacttctctgtgcagaagggatttctgggcagcacatggtcctcacatgcagtcaagtctggaagcttgggaagttatgggaggctctttttttttttttttttaattttgctgccaataacatgacggatcgaagaaagcaaatagctcttttatcacgtcacataaatccttatgactaatttactagcacagtcatctccaaagagcaaatgtggatactgggtgaaatctgttaccatcaaaaccaccacaaatcaggcagtgatcaatgtttttgtaactatggagaaaacagcaatgggaacccattttcgcagttcctgcgaatgtagagcaagtggctaaatagtcaatcggtggcttcactcaaagatatttttcactgttttcttctgggcagggtgaacagtgacaatgcatattctgaaaatttatttcaaatggtctaggcagtttctctggaaaagtgggcagaatattcctggggactagggagaagccaacaagcactcacaaaagtcaattttctcatctgcaaaagcaaaggaatatatctcctctgagaagggcagcagcatggaatccaacacacctaggtggcagaaaggtcttgggcaaggataaggattatgtcagtgaccactgatttatccagccagacaccatgctcagtacattgcataaatcgtctcattcacccctcgtacaatcctgtaacttacacacattactattcccatgtttcagttgagaaaattcatgctcaaagaaattaaacaatgttccctaagccacatggattgctgataaattgcagaagccaagtgaatactcactttaatcacattccacaatctacagcctcagtataagagtaaactgccaactttcctgtcccactcttgttcttattcccaaaaggaattaaggcaaccctttaaagaaccattatggtcagtttcaaaataaataaacaaacacacataagcaaggaaagtggagtatagagaaaaatatcatcaaatgtgtgcttgtatccattgcagggcagctacactgttgcatttgaggtctctgagattttattctcaaggtgaagcatgtgtttaaataatatctagatttctaataattggttaaatggaagtatggaagtacatatgtgttgtgaaatgaaatacatgtaattcatccctactggtaaaatattaaaacatataatttcatctaatggtcattaatatttgaaattcaggcagactctttaaaaaaaaaaaagcaattcattttgggaatcaatgcagaaatactgtatttcttaatcatccatccttgcttcccacactgtagtgatctttagccttgagggattgcaaagtctttcctgggcaccataagttggcctctgtttttacacacaacactgtcctgaaaatgtatgccaaaggtcagtatgacaaaagtaagcaactgaacaatagttatacccagtgtacataagaggacctcttttcttttgaggcaaatagataaaacactgagttacacattgtccttcagacacaaccttcagcaatatactttcattatgttatacatgttcattaagtttatttttattcataattgatcatatattcattctaccagctaagagccaatgaacattagacaagggttgaaggtttgctacttctgatacatctgttgctttcattttgattgccattgtgttatatttataaaagctacactttctactatattactagaatttccttggtttttttcatccatatttatagaagaaaaccagaagaatacaatataatagtaaaacaaatacgccaagacatatgcatctataccaagacagccaatctactgaaagggaactatgagcagcaactggcatctctaagtcacagctagaaatgtccactcctcagctgacacacacagactgcagtatcttttttttgtttttcttattttatatatatatatataaaattatactttcagttctagggtacatgtgcacaacatgcaggtttgttacatatgtatacatgtgccgtgttggtttgctgcacccattaactcatcatttacattaggtatttctcctaatgctatccctcccccatccccccaccccacagcaggccccggtgtgtgatgttccccgccctgtgtccaagtgttctcattgttcaattcccacctatgagtgagaacatgcagtgtttggttttctgtccttgcgatagtgtgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcgtgtcagactgcagtatcttaaaggcaagttaggagtgttgaagtatagtttgcaaaagtacatgatgtttaaaaatattaaatgtatgaaagttgaggactacttatgtcatataattacaatatcccctggcatagacggaacaggctttattttcccaatgctatcagaaagcaaatgatataaaggaaagaaaatcaagattatagacccatgaatggaaaagggaaaggtgtcatcgcctggaagcatttgtgttcaacaagtgagccaatttgtatgcagatattccttccatgccctatgtatgagcaagtcttcttaaagctccggatctagaatgaccaaggtggtaagttttagtccctagaaaggaagggtaaatgaaaaccagctccctgtagaagtacacaagttggttttatacatctgccaaaaggacagctgcatacgggtatcagacagtaagacagactgacaacctttctcaaatgaaattagaggcattcaattctgtcctaattagctcgccctgaaagatcaggatttctcaacctcaatactactattgacatttggagccagatactcctttgtggcaggggtatcctgtgcatgaaagagtcttcagtagcatccctggcctctgcccatgagatgccagtagccattccccacacttgacaatcaaaagtgtctccagacattgccaaatgtcctcagggaaagaatgagccaaaatcatcgtgtctccaacctgcccagtaagagtcacagccttagatgatcaaagccctttaagcccacaatggacttgggtatgcatgggtctgtttgaaggattcaagtacaaagaattgcttcccaatctgttcccttggctgtgccatgcacaaataagccaatattcatggatactataaacccactcaacccatctctccagccagatatttgctgaagttagaattttatcacccagcccacacacccatgtgaatgatatgggttggattgttagtctgagtgatttctgaaactggaaatctgtcaaaagttagtaaaagaactactatccccaagttttgcttaaatagtcatttagcaaattcaatgttcttttaaagttcttaggatgcattagctaaaattagaaattacctaaatggcaggcaacagagttgtagttaattaaaacatagtaaatccttaaaatggaatcgcatgtcatccttaaatatatttttgaagactatataatgacacaggaaagtgccgaggacatggtgataaataaactaaccagtatttagaatgatataaatacatgcgtacatatcgtgctgttcaaaaaactatgagcatgatgttgtcagcggctatctcagagtaacaagatgttgatgctttacatttccctctttttgccttcattttccacatgttcttcattgaacggttaactgttacataatttgaaagacccaaacattctgtaaaacatgctacctattaatttatccaaaacaaaaatcaaaagttaattttacatgctctcttttcctataaaatccatcttggatgttcagtttcttaccaaattattgttttgctcaataattggcaatattgattgccagctggtggcaaacaccataatgactgtgtttgtgaatcagaactaacactttcttcccacccgtggtacaaatggaaaaacacaaacaacacagcacccttctttgctggaagcatggcgtcccttgcaactgtcttgattctgtttggccacgaggtagcaaacactagtaccaatgcatagatctccaacattcatttctaaacaaaagccacaaagaacaaacatctccacttcaaagaaaacttatgagtcagatagagtctaagacatgacaaacatttttttaaaaacactgaagaacatgactaagattaggaggcatgaaggatgattggaaaagcgggcagcttggtgaggatgtgaagggcagccggggagaggagttcaatgaagagcaactctaaaggcaggagtgtgtcccaggtgcacagccagagttccagcagatggtagtggaaggtaaaccaggcatgcaaattagaggggaccaccaggaccagggcagaaagggggtgaacaatttcttcatcattcttcagaagagttatattcttacctgcagaccagaaaaataggaaacgacctgtaatggttggaacagaagccaggattgagcttcatctccaatctctgctattactccttgtaaaaaatgtttaggggactataatgagtccatgattaccattgctttgatcatttcactgttacttgtgggggcaagtaaagaacagcttttgacattttgtgcttctaagtcttcaactctaacccacaagtaagtgagctttgggtaccacatgaagaatttcagaacaagaattttctgaaatgaaggcaactaaactcagaaatgtcttttgcaggccgggcatggtggcctatgcctgtaatcccaatactttgggagacaaggccagaggattgctggaagccaggtgttcaagactagccttggcaacaaagtgagactccatctctacaaaaaatttaaaaattagccagatgtgatggcgcatgcctgaagtcttagctacttgggagactgaggcaggaggctcaccttagctcaggaggttgacactgcagtcatgatcgtacccctgcactccagcctgagtgacagagagagaccctgtctctagaaataggtatataaataaaaaataaaaataaataaacgccttctggagaaggccagaacatctccatcctttgtgtctagtacatttgctgacattgccaaacacacaatttctcttgggcccattttcttatcagtaaaacaaaggactcaggaaagaaattttatggtcctctccaattctgagattccaaggtcctagaattctttaccacatagcctatatttccatctgcatggaacagagtaggtaggatcagatccaaaatgcaactcaattcacttctactcactcaacattcaaaattcatcccacaaaagttgaacacaaaattcaactcaattcactcaacactgtgttgaatgcatctctcttggaatacagaggtagcttcaaatttctcaagtggcttcccaacaccagaattctgacactttccatttatcagtgtgtcccagtgtaatagggtgactccttgactgttccttggatattcacctttgtgtgtaggcaagcatcctgcatcacctcttttgacttccttggaaatagccttgtttggtgagatgcacacgttctgcaaagactcttatacaagtaaatagcagcaaatgatcgatgttcccactttgtttcatatcagagccaaacgtagaggaaacaagcatggcgctcaacaacacttggcttgggtatcacggcctctagcaaatgcattcccagggtcagccaaagttcagcttcatttccatctgagagactttgctttgggtttcagagccctgtttggctggataactccactttgatcattttttattctccctgcaacatgatttcttaaaagcaatgctctttacatctcatttgggggctgcacttaacactgatcaaagataatgacattttcagcaaatgaaagataccatttccctgctctgtctttttctagggcaatttgttgaagcagattttagggaaggctaaaaagtaggggaagtgctccaacttgtgttgctgtggcaacttctacagaagctcagatacacttgctctgcttcatgaatgccgctttacttcttaaaatatcgatttccatggtgcagagatgcaattagtcaggtctgtaaaggaggagggtttttttctctctcttagatgctggaaggtcaggttgaaatgaaaccttttcatcgatataataacagtggagcttaaaaagctattccaggtgtgcttggatggagcaatgggtggtgtgtatgaaggcatcccaccccaaagaccaaagctgtcagagaccacctgaagacaatcatttgaagggggcaggggtgggtgtcattacaatgtggtacttagcaggcaagccaagaaagccgcctaggaaatccattctgtggcactttgggtggttcatagaacgcttttaggttgcctgtacaacttatgaggctctgtggtcctagtccctgacaactgttgggccggcaacaggtaccgaacattcgttctctacaggacaggatgaaatgtccagtgggtgctgccggcagaagaagagggaagcacaatgcctgacctcaggaattgcatcataaaatggaagaaaagcacaaataaatgacacgaaaacatgcattgcaaaaagacatcctacttcctccccatcctcttcatccattacatcactgccaaagaggccttctaaaatgcaccacagaatcctttccaggaaccagcaatagcctcttattacctacagaataaaattgcattcatctgggtaaaattctaagctttctttcatgtggccccaactatattatcatcatttttcttctgcgtgccttctccaactgcctgctgccgtattgtttctgcattggctttcccacattgcctttgaccttctccaacttggcaaatgtactcagccttcaaggatgacgtctgactccacctcttccaagaagccaaccctgactctccttttctttgccctttgcttttacctttattttagtatttgtaagctacttgctctcatgagagatttcctccctgatactagcagctccttgaaggtgaagactgtgccatattcaactctgcattctccacagacctgaatagggtgctttgtacaaagcaactgcaaaaagtacccactgcacatacagacttgcagacatgggcatatgtctgtgtgtggtcagtgcccagctctgcagacccaatgaagtttggcagttgtgggagagattgggctgggtttggggtcagatggggcttgtctaagaagattagattacagaggagtcctgagcagtgttttgcagaaggaaaagagctatcctggcgaataaataacagaccacaggggaaccagtatgtgaaaatgctggagggcaggaatagaggagcccttcggaacttggtctgcctggaatgccaagtattaactgagatgttcaatgcatttaaagggaataaaggattatttttaaaccctctcgttccatttacccttcttccttccatgaaggctgcatggcagaatggaaggaattgaggctttggagctgagtggcctcgttagagagcccacttgtgttgctcaccagctgtgtgacagaaattacttaacttttaggagcctcagttttctcatctgcaaaatggaagcaataccttatagtatagattaagccataatcatagggagctgcctcacgtgctgcacatagacagacaacaaaaatgtacgtattcacatttttccctgttgggtaataatgtatagaacatacataagaatttaatttcagcacaaagcgaatctcaatgctatctgtaactgttaaagaaaactcttttactatcttaaatgcctctttgcttttatgaactctgtttcatagttaaagtggtagccatgaagtccaaggacattgtaacaggattataatttgtaggtgcaaactcaggactgcccttggagacaaaaaaggtacttaaaattgatggtcacactggatttagtaactcaagtccaaagaatggggtatggaaagacaaaacaacaagtaacatcacagcggagaacctggcaaataccaccctaactgggcaatcaaggtcaacaccagcagtgataagtcatatggatagcatgcgcccttgaaatcatgtgagaagaagggcacctcgtgcctgtggtgttcttccccaaacccttaaatccaggctaatcatgagaaatacagaaaaacacaaatccagggatattctataatataccttatcagtcctcctcaaaactgtcaaggtcatcaaaaacaaggaaaacctggaaaactgtcccagccaagaggagactgaggaaacatgatgactaaatgcaacgtggggtcctagatgggatcctgggacagaaagggaacatttgtgagaaaactaatgaaattcaaataaagtctggagtttagttaatagtagtggacctatgctggtttcttagctgtgacaaatgtgtctctacacatttgttgtaaatctgaaatttgcttcacaatacaaagtttattaataatgtaaataactacacaaacagataacatctgatgcctgcatttaccaccatgcgaaacaggggccatgaacatttgagctggatgttggcagaatcgaggctgcagccacccaatccttaggccaccacacaagcctcagatagacgtgcccagcctgactgtcctgtggtcatcaccttggaaacatgaatcctgacttcctttcaagatcactcccttccctacaatgcacactactgcaaaactagaatctcaagcaatcgtgtgtgagaacatgtgtgcagaggaaaagaaacagttgtatttgtttataattgttttaagatcccacaatgccaatcatcaggatttttttccaaattattttcagcattgtacaatccatatccgtaaatgctctttgtttgtttgtttgtttgtttgtttttgagacagagtctcactctgtcgcccaggttggagtgcactgcaccctctgcctcccaggttcaagcaattctcatgcttcagtctcccaattagctggaattacaggcatgagccaccatgtctggcgaatttttgtatttttagtagagatggggttttgccattttggccaggctggtctcaaactcctggcctcaagcgatctgcccacctcggcctcccaatgtgctggaattacaggcatgagccaccatgcccagccacataaatgatcgttgaataaacattttcttgaagacagatatttcaatgttgccttcacaagtagagtagaatgctatcataatgaaggttttcatttacttctcattagtcccgtcagcaatacggggcactgggaagaagccagcctgctgaactgattgctgaatcctgggtgtttagatcagtctcccactctctggttgtgtgcaccacctagccaagggatttggtctcagttttccaaattgtctaataagagtaatattccttataccctatatttgttaggagggataaatatacataaaacactgggcttcaaagggctaataaatgcacaaatacgaatctgaccatttgggcagcagtgaagccaatgtttcccttttgtccagagacagcgcagagaaagagtataaacaagacgggatgtgagctttgtggaaagcatttgcaaaatctctcttcaatgcttttcgaagacctgctcccactggattgctgtgggtagttctcaggctcagttcagcttcaaaatgccatccttcaattaaaatagggtcccctgtgtaacagaaagtgccctagttgcatgttatagagaaatattagcaatgattctcctccaatatcctcttaaaaaacaaaaaatataattcttattgaaagcagcttaactgtcttgaatatacaaccattgcaaagatggtttcagtgtgtgtgtgtgtgtgtgtgtgtgtgtgtgctcaagcgtgtgctattccagagtaagccaagattctgactacaaactttatccactagctgatgaatagagtggatatgtattgccattctagaagtcaagcatccggcattcagcctttaaccaatgatcaaatttagcatcatcaacaatgggacaacttataccagaggcctcctgatgtatgatttattaagaaatgcatttcacctaggaagtattcttaccaagaaatgttaattttaaatccaattatgagcaaacagaaagatccagaatggaagacattgtgtaagacagtatttctcaaccttggcgctattgtcatgtgtgtccagataatccctcgggggcagggggagttgccctgtgcactatagcatgttcagcagcatccctggcctctacttgctagatgccagtagcactacccaggaacaacaaccaacaatgtctctagacattgccaaacatcctctggggacgaggagacacatttgtctccctccctcatgccctacatgtggttgaaaaccacattgttagaaaactggcctgacccttcgatgttttacaggcaactaaacataaaggaggtggcgcaggcaactaaatataaacgaggcagcacaattctagataacatgcaataaccaaatgcatgctggacacaagaccaataaccatttcctaagtgttggcactgctcttactcacagatgccctactgtgctcagaacagggctgcatcttcatgcccacaccaatccctggggtgggggtatccctaaaatgcagaatttccatctgcaggtctgcattgcctatgagctccaagcagctgccctctctgctgtctacaagccacactgggccacaactagaggaggggtttttttttttctttttttttttaacatacatgtgttaggttgttgattcacctgcaattaatatattgtcaaagcattatttgaggcctggcatggtggctcacgcctgtaatcccagcactttaagaggccaaggccagaggattgcttgagctcaggagttcaagaccagcctaggcaacatagtgagactgtctctacaaaaaaaaaaaaaaattatttgagaataaggtgcctaactacttatgtgactgacatatcttttctgcttttgggtagagggggaagatggggatcacgtattagtatattgtctaaaggaagtaggcccctatcattaaactcaagataaactatagtcatttgtatgagaatttaaaggtagaatatttgagaagtgtaatgaaattattgaaataatttctataacatgccaaatttttcaatgtttttactttaaaatacagcttatttgtgagaggaaatctgggggggaaacacagaaaatcagaagaaaaggaaactacagcttaatcatttaaatttaattgctaccaacctttgtattttaccccagaccttttccctacacataggcttatgttgttcgtcatcataacaattttgtctccttcctatctgtcttacattcaggagcacttgtctgtattattatgaatttttcctgaacatcacattcgtgagtcaataatattccaaatcacatttaatatgccatcctccgaagtgagagagcattcacttgaaactttcctttttgttaaactggtttacaaaccataaatgaattttacatatttctaggaggaggatattcaatgttccgaacacaaaaaaagtgacaaacgtttgtgatgacggatatactaattaccctgatcttatcactatacatcacatatattatgacatcactatataccctataaatatgtataattattatgtgtcaattaaattttttaaatatttaaaaatgtttaaatgtatttacgtatttatttttagagacaaggtctcgctctgtcactcaggctggagtgcagtggtgccatcacagctcactgcagcctcaaattcttgggctcaagccatcctctcacctcagcctcctgagccactgcgcctggcaaaaatgttttattcaaagaaataaatacaagcaaaaactagggataaatgaccagagggagctttcttcgaaaactactcaggcaaatttgatgtccatcctgctacctccttggtgtgttgatcacagcttgatcaaagaataaaaggactaaaatgctttcttctttttcactctgaactatggggaactggaccaccccaggtggttctagctgtaaaatcattggccaacttggtgtaaaaatcccttgaaatactcacaatgccctcagcatggccaaggatgagcaagatgggtgctgattaacctaattgagttaatccacttctctctggttggttgggcggttcattggctgctcctcctacactcagagtcgagggactgtgagccccttagatgttcacctgtatagcatggctttgaaactttttaaagtctatagcctgaaagactacggtttcatgactgagcattatgcatttttagaaacagcagttaagctgaaaatggagccgaactcttacatgcagagcacgctgccgaccctggagcagggctcggggagcacagaaaggaggaagagccaaactttgctgtcgacacatgtccaagactaaggccagtgccctgaaagcaaactctagatcatacacgagcaagagctgtgggacaggacagaggcttgtggatgctgcttcttcgttgacttcacttatttgggggaaaccgcagaagtcatcagagcagacatcggcaaagcggatgccaagcactggttttttaaaaaatacggatttgatagcccaggtgaaaatggggaacattcaaaagaaagcaaacactgggacactttctcacctttaattccttgccctccgtgagttatccgaaattgaaccaccccccatggctctagctacatggtataaaatgtacttggcagtcaaatacaaatgaacacatgcagttttatattgtcaagccactgcttccctttgcttgatgaatcaattgtcttcatttaaaaagaaaaagatgatgggaaggaattgcattcttccccccaccccctgcaggctggggtgcagcggcgtgatcacggttcactacagactcgacctcccaggctcaaacaatcctcccagctcagcctcccaagtagctgggactacaggtgtgtgccaccatgccgggctgattttttgtatttttagggcaaaatgctgggattacaggcgtgagccaccatgcccggcctgcattctttatttaaattatttagatggaaatctaaagaaggcagtcccagtagcctggacaaagtggtccaaaacatcaacaatcaggactgttgggggctgtgtgtgtgaaaggttgggtgaggaggggccacctgcctcagaatcacctgcggagtttgtcatgcgtgtggattcccagacaccatcccagacctgctgagtcagagtcttccatgtttaacaagctccctgaggggatcttccacgtcctaaagggtgagaagcatgcactgcagtttttggagatgagatcaacaagatatagggtccaggtgtcacaaaacgcaccttaaagttcctgagcaagcagaaattgccagtgagcctttagagaaagccttgggttatacaagcatttgaaggggccacaggagagtctacaaatagtgaatcttctctgtgagatactaaaccaacccctttagacttgcagacaactgcgtaagaagaggatgcaagggagggagaggggcgtaaagggagaagggaagaaaggcctcaatccagccgtctgcagagaacacaatggagaattcttcctgctgccacttaaccaaagccctaccaggcaaagtcctctgctgaaagctccgagtcttctcgggcttcgacaggtacatcctggcaggctggtttgctcaacagcagactgtctcttgtgagaggaacgccagtggggcatttatgagcactgtcttttggcaacctcactacgcaggcctgtgaacgcgcagccaagaatcccagcacacctctggcatctgtgtgggcagagagcagtgacgccaaagtccacttcttgaaaacgtaaggcttcatggctttcttccacaaagaagtttctcatttgaatgactttaggaaagcacatctgggggggaaacttccaatggtagggttactttcttttgtgggccattctgtggaagattggtgtataattcttgtatggaaaaataaagcaggagcttctattcatgttgttcaaattgtcagactatgaaggggcagtgacttcagcaactgagtgggacgcagcaggaaaccggtgattagaagtgggaccagtccatatttgttccatgtatttcctaccaatcttttcggggccatggttgatttggtcatggcacactgattatggtgaggagacacagtgttaggctccctatccacaccaactattaggtatttgctaagtgtaagctagacctgggatgccacgctggaagaggaataccgtgagataaccccacccttcctcattccttctagtcacagttaccaccatggggcgaggacggctcaaactggatggaaaggtagacccatgagcatacaaattttccttccagcagaagggacctgctatagtgagtcacgatcatctggcctccaggaatctcaactccatctgactgctcagccctgcccatgttcacagatgcccagactcacatcagcccagctttccctaaatgaatgaaaactgcagcaaattcaaatttcgcagaataaaactagaagtccccttccctcactatctctaggtggaaacatcatgtttcacatccaagagactgatgctagcaaacataccataccgttcacatctgatcctgctaacgacagctcacagctggttgctatggcacccaagcaccccacatacaatcacagcacccgcacagcagctggattcaggagtcaggtagcctggagttgaggcaggcttcacctgctgtagaccatctgtgcactctcctagctctctctgcctcagtttcctcattgataagtagagacaataataatgccaacttcatagactggctacaaggcttatgtgagtcaacatttgtaaagggcttagaacagtggcaggcacatagttaagcatattcacacaaattggttggcataaagcagagatttatgatctcacagttcaggaaagcagaagtctataatcaaggtgttggcaggcttggttcctcccggaggctctgaggaagaaaccatcccatgcctctctccagcttctggtgttgacagcaatccttggtgttccctggcttggagaatctcttggggaatctccaatcgctgcatccatcttcacggcctcctctttctgtctcttataacgtaaacccacccccatccagtatgatctcatctccatccttatcctaattatatctgcaaagaccctctttccaaataaggttacattctaaggttccaggtggacatcaattttgggggaacattatttaaacactacagaaaaaatatatgtgtttctgaagtaattccacacatgaaaggcaaacttctccagtttcagtgtgactgtcattttttcttcctgtaatgtttagaagaacttaccagtgtagctatctaggcctggagttttctttgaggaaatgtttttgactatggatttaattccttgaaaatgcatagaatatttcaaattgcctatttctttttgtgtttaattacaaattcactcttttcgtctaaatatttaaatatattggccaaaggttttgttttttgttttttggtttttttttacggcttccacttattttctttttaatgcctggcagatgtgtagttatatcccctttttcattcctgatattgacatcttgtgcctttcgttcttttctttttttttttatgattagtccttccaaggaattataagttttattagtactttcaaagagcaatgtttggttttgaactttggttttcttgatttttccttgttctatatttgttttccactttattaatttctgttctttaatattttcttctactttatttgagatcagtatgcttttttcccctaacttctggagacgcatgttgagattcctgacttttggcatttcatcttttctcatgcctgtatttaatagtaaatattttcttctcttcagggttttaactgaatcccataaattttgatatgccatgatttcaattccattcagctgcaaatattttctaatttccgttgtaacttcttctttcacttttctactatttagaagaatactgcttaatttctaaacatgggaattttctagttatctttttatcactgatttctagcttacttccattgcagccaaggaatatactctgtggaattttaattttttaagatttgttaaaacttgctttatgagtcagtatatggctaattttggtcaattttctatgtgcacttaaaaataatagtatattttgcagtctaagctttagcgttttattacaacaattaggaaaagtatgccaaacatgtttaaatagtctctgcttctgaatttttgtatactattctttcagttgtagagagagatatcttaaaatttcatgctttaaaaaaaggcaaacttctctgatgaactgtgctctccctccgatgacaacacccagcgtgaacacaatcctgtctcaaaggggaaaggcagagcttccagaactttccacatccatgagcaagtgaggaagaagaacttagaaagatgctgacccagcccccccacccccaccccagctggatttgcctctgaattcagttgtaacaaagaaatcctcgtgtgcctggcagccctgggccccttccctagttgggaactaagggtcacaggggccaccgcactgcatccatggagatgccatgagcaggctggggcccggctggcacaagcatcagcccagcccagcagacagcagttcccactcacacctaagccttccccaggccccaggcgactcatctccctctcacatcccagagggaacctgatttggagctttgttgtgactacacaaacacatataaatatgcgcacatatatatttactgatatgtaagattttatacatacaaatttataaattattataaatatgtaatatttgtttatatatttatgtaatcattgttttaattactatttgtaatattaaataattttataaaacattaattatataacattgtattattgaaatataacattcaagaactatataattatttatataattacttgtatatacataacataaagttatatatataattatatcgttataaaatcatatgatatacatatgtaaataccacctatattatataataatataatttcaatatagatcaggtctttatgtttacgtataagtaaattatatgtaaatttatacacaaatatttatattaatttacatatcaacctgtaaagtatctatataagtttatgtatgaaatatgtctaaatatatttttaaaatatatttaatatttctaaatacatagtatttctattaatttcaacacattaatttatctattttgatgaccctttgtagaaaactgactataatccatgctggggtaaagtcattctctttctcctgcttttttaaaggaagttaaaacattttcatgggtcctgggcactgtgcctcgtgagcctggtggagaagtctgtgtggcctcgaggaggcactcacagaagtttgacattctcctctgccaccgtgagacaagtggatagtctgcccttaagatgacatcgtgagctcagcaggacagtgtgtgcagccccgcagtgactcaggaaatgttcaatgatgatcctggatggtatagacatctacgcactcggatgtgacttcctctgagaggtagtgtagccccacatccagagaactggactgaattcctatgagagttgaagtacacatatcaccaacaaaccaagaggcaggaagctctggggggtttcatcctcctctgaaatggaaaagtgagtttcacagaactcgtgtttctcttattagaaataaacctgctaggtaatacccgttgatgcctcaggcgtaggactttgtgtttatttgcacagttttgggttaggaccaaatttggaagattttatttttgtatttctatagtgatacacagaatctaataataaaaaaaatgtgaactggtgtaaggaaaaaaagcaccaaagagtgattatgttcattgccaatgatttatcacttgctgaaaaatgagggatgttccttggatgggaacagaatgtctgccagagcatcctcttgccaacagaggaaaggagatgcaggagcaaggactgttcctgtcataaacgtgaatcctggctgggtgtggtggctcatgcctgtaaccccaacactttgggtcaccaaggtgggtggatcacttgagcccaggagttcgagaccaacctggccaacatggcaaaaccccgtctctactaaaaatacaaaaattagccaggcatggtggtacacgcctgtaatcccagctactcaggaggctgaggcaggagtgagccgggattgtgccactgcactccagcctgggtgacagagcaagactctgcctcaaaaaaataaattaaaaaaaaattttttaaataaaaacatgaatccttctaccatgaatcacttccacttaatctagatttgaagatataattccatatgattttttaaagccacattttattttgtaattttaatttttaattttttaaaggcagaatctaactttgtcccccaggctggagtacagtggcgctgtctcagctcactgcaacctccacctcccaggttcaagcaattctcgtgcctcagcctcctaagtagctgggactacaggtgtgtaccatcatgcccaactaatgtttgtatttttagcacagacggggtttcatcatgttggccaggctggtctccaactcctgacctcaagtgatctgcctgcctcagcctcccagagtgctgggattacaggtgtgagccatcatgcccggcctcttatgaaattttgagagagtgcttagctcccctttgctcatggcattgttgaattatggtccctaattccagcgggacaaaccctaccgtactccaggctcaagtgattcgaatcaaagataaataaaaaggagtgtatagagagcagagcatgacggcagaggtgtcagatcaacacggcactcactctgcatttttccaaataaaattcaaactttgcaaatggatggtgccaggacacttgaatatttgtatggggaaaacaatgcatcttgacccttgtttcacaccgcacccccaggttgactcaaagcgcatcatatatgagagaactaaagctcttcaatttctagtggtgaacctaagagaaaaatctgtgggaaatcagatcaagtgaggatttctgtatcaggacacaaaaggcacaactatttttaaaaattgataaaatagacattatcaagattaaaaaccttcgctgtctgacagatacagttaggaaaaaatgaagaggaaatccacagtgtggggaaattttgcaaaacatatctgacagaaggcatgtatccagaatataggtaactctcacactcaataagaagacgaaaaccaacccaattttattttttatttattttttcttttaaagaccaggtctcactctgtcacacagagtggagcacagtggcacagtcacagctccctgcaaccttgaacttcttagttcaagttattctcctgcttcagcctcccaagtagctaggactatgagcatacaccaccacagccagctaattttttttatttcatactaagacagggtcttgctgtgttgccctggctggtctcaaactcctggcctcaagtgttgcgtctcaacttttcaaatgagcaaaagataagaacaatcacctcaaaagagaagatataaatagtcaatacacttacaaaaagatgctcaaaaccattagtcatcaggaaaatccaaatgaaaatgcctatacatttaatagaattgataaagttaaaaagactgacagtaacaagtattaatgaaaatgcaagccgggcgtgatggctcacccctgtgattccagcattttgggaggctgaggtgggaggattactttgagctcaggagttcgagaccagactgggcaacatgacaaaaccttgtctccacaaaaaatacaaaaatcagccaggcattgatggcttgcgcctgcaatcccagctacttaggaggctgaggtgggaggatcacttgagcccaggaggtggaggttgcagtgagctgtgatcgcaccactgcactccaggctgggagacagtgagaccctgtctcacaaaaaaaaaaaaaaaaaaaaaaaaggaaaatgcagagcaagtgaaactcacatatattgctggtaggaatgcaaaattgttcttataaagttaaacacacatgaaccatatgacccaacaattccactcctaggtatttacctaaggaaagtgaaaacatatatccacaccagcatctgaatggaaatgcttatttaatgtatatgttacaatggctttattcacaatcaccaaaaactggaaacaacccagcaccattcgacaggtaaatagagaaacaaacaaatatccatccaactgaatactcccaagggatagaaagaaaagaatgactgtatcatgcaactcaaatgcatgatgctaagtgaaagaagccagacaagaaaacctcatactgtatccttccacttatgtaacatattagaaaatgccaaaaaacaggttccacgctcaatttaatgctctgctgttgccatctttaaattcttaatttttgaaaaggggtcttcatcctttcattttgctctggaagctgcaagtgatgtagctggtcctgcttggtttcaccatgcagtgtttttgaaaatatgcaagaatttgggaatgacatttgttcctatgcttacctgttcccaataggccccacactcttaattttttttttatacccagagcttcctgaaacatccacattactgcctgactccagaaagcattcaagttttcaaaacttgcaaaagcatgctggtcacctgatctcagaaaccgcaaaagaaaaaaaaaaaaaggcaattgcctacataagaaaaatcctgttaaccaagtttacactcattctcctcagcctgcacttcagtgtctggtttgaatcacagccacacactgtcgaggcccctctgagatgtgcaaaactcagcctgtcatctcactagattattccaagtgttccaaggaccgatggaattttttgctttctgtcttgatgttctcttggcacccacccaggaaggtcttgggtagtgcactgaaaaggaacatctccaatctccatccaggagaatcttaacaaatgtccaaatgtctctgctttctcaaaatctgcctcatggccaggatggatgctttctgccctgtcaagtttccagctcccttttctaaaagtagccttatagagccccgtatctatagaattcctgcaattgatatctctagagttcctgcaatcggcatggcaatcagcatggacttgcggaataaaaagtgtcatcatctccaaaaagcaatccacaccagggaaaaacaaatcatcttcaatgctgtgaaaatgccttggtgatctctgacaaagaaatttaagggtttgtattaaaactggcagagcaaacttcctgctgaaagccacaggccaatccccagagtaacatacgtcttgacagcgagaagagccactgacatcacattatgagtttccatgagcaacaacgatggaagccatggagaagaaaaactgcactgccaactgcctcaaaccactccaaagacaatttttagtactggaggagagaagagtgctttttcatcatgcagactttcctgaattgatgctgagagggatgcagcaattttggtggtcaattctggtggcgcttccaaatgacgtgatgtcgcgaaggtacattccgcacaggctggcccctctacgttgctgagaagcactccacaagcacacactctcgttattccactccacacaactgtgaaggaggtgagtggaaaattgttgcttttcttgtgttacagattttctttaaaaatgtgagggtgcaaagggttaatgcgtgttttatttttgaaatcacaaggttgctccaatgccatctccagctatgggggaaaggagctaccactgagcagggagtctcactctgtcacacaggctggagtgcagaggtgcaatctcggctcactgcaacctccaccttctgggttcgagcaattctcctgcctcagccccctgagtagctaggattacaggcacccgctgccacgcctggctaatgtttgtatttttagtagagatggggtttcagcatgtcagccaggctgctctcaaactcctgacctcaactgatccacccaccttggcctcccaaagtgctaggattacaggcgtgagccaccacgcccagccagcacatttccatttgaggctcatctcctcattatttggatttatgagaactcaagtcacagaggtagcattttatatgacccagaggaagggcaagcgggcccatcagcctctgcaaactagcatcggcagaccttggaaccaaggcaagggggaaaactataaatattctttaggactttgaaggaaaatgtgtgtgagaaataaaagtgaaataaagatttccctatgctccagttggtctagagcagagctatgaataatctaagaaggcaaaacagcactgcattacagcaggagagagatggtaaagttgacatatagaaggatgtatgtgtattcatatgtatgcatacgtgtgtgtgtgtgtgtgtgtgtgtgtgttggcagccgtgtaaactcattcaagtaaagtaaaaagaccagcctaattactcaattatggactgtctaactgatcctgatttcacaaagcattttctttgacaaacattaattgaaagcctgctctacaacccaccacaaatgaattttcctcaaaaagtattcttttcagtatgtcagtcttgtgttccagttactagggtacataacaaattatcccaaatttgttcgcaaatctgcaacctggacagggctcgtcagagataggttgcttcttttcctctccgtcttagctgagggaatttgaaggccaaggctggaatcctctgaagactcacatgtctagatgttgatattggctggctgttggctgagatctttgctagggctattggttgaacaacttatacatggcctctttgtgtagtgtgggctttctcacaacatggtggctgtccaacagccaatgttcagggaagaggtagaagccatttagaattttatgacctagcctagaagtcacatagcatcacatttgccacattctacttgttgggatggtcacgaagcctcactcaagtttaaggagataagaaatagacgctgccttctgatgagaaatagcaagatgctagaagagacatgtgggaccagaaagcttacagtaattcatggtctccactccggcaactcacagagtgatgatctatgatacattctattgcatcgtctaagacacaagtgcttgtgacaattgtggagccataaaaagagatgtaaccaccacccaaagttcccttagcacccacagatcatgagattaaaatagcctcatgagaaaaaaatcagttattatttctttatccactcacagcattagtacaaggcagctcattctgaaactcattagaaatcgtaacataacaacagatattattatctgagaagatatatccactatccttgaccaaaagaatttaaatggaaattttctacagcgtttctacaaaccactatttcctttctagcatgctggcttcgacagcagagcagtgattttcaatttgttatgtgctaaatattttaattacattttgaagtaagcagcattccagaaaagacaaatagtccaaaatgaggtaattaattcttgaaggtaaccatactaatatatgcatctttcatagcagaaattaattattctcaagacaactgtcttttccccttgtaaattaggacatttctcctctaattagttgaaaatgcctgtaggacattatcaccactgagctatggaatttccttcagcaggtaattccagttagaattgagaggtgtttgaaattgaaagcagagttttaggcttcagcttgtttctgctcagtggggtgcagaatcacaaatataaaaccatctacgattatgaagagccattcatcctgtatgcatgggtaagtaagtgtttagcagggtgacctggacaaggtaccagtggaaatatctctttctcatttatactgtcatcttttatcttgcaaaaacagctcatgctaagaatgcaggaatgttttccctgtgggtcaagctgcatatcatgctgagatcccaaccaagaaagaaagggcagtgtgttcactactgtaatgtgccacttagcgtgttactcagataaagttgaatctagaactatctaccagcgcttctttctgctcctcgaggaacaacagcacttctcctccttgcccccccaccccccacccagtgagagcagtagaatgaacaaggcagcttcagcccattgggaaagaataaagaaccctttgcctgtgtgttatcagcctcaatcatcgtttagcatgaactctgcagccccctgagttgttggtgaactcagaattggtcaattcaagggaaggaggaccaggccaattcactggcataaggcaacatccttgagagctggacacacacattcccagctagatccagcccaattcccaatgcataacatcatcataataataattagtgtttagtgaatttgtaattaatgaataaattgtggcaactgtccggttttttattctttaacaattgttttagaattattcactttagaattattcaccaaccaagtactaggtcattatacggtagtcaataaaggaagcatcatctctgcctcgtgggacatatatttcagtagaattatgtttattccactgaaagttatttatataaatagagatcaagtgcacaaccatttatttcaaaccaactggcagaattgtctcctcagttggttttaatgcaaacactcagagaccactggagttagtgtcagttttttaaaaaccttataaaatatctatttttaacaagatataatctcctgcaaagcaaggtgcagaaagctataatacctgcaagctgtcctcctacatcaatcttgttccaagataacagaagaagatgaagctttcagatccaagatttacccaccggggctgtaccaggttaaatgaatatagataagacataatctggaacaaacaaaaccacaagaacagtatgtactgtaggagtctgatcatgcaaggttcaaaaacagacaatgctaattcatggtgataaaaatcagaatagttaccctggttgtaggggaggatggtgactgagaaaaagcatgagagaatgttccaggacaccagcagtgtttctagttatccactgaatggtgtttacagatgtaagtatatggaaaaaaaatcatcaagctgtatagttaagatgtgtgtgctcagctgagcgtggtggctcatgcctgtaatctcggcactttgtggggctaaggcaggaggactgcttgaccccaaggagttcaagaccagcctagtcaacatggtgagacattgtctctacataaaaaaatttagctgggcgtggtggcatgcacctgtggtcccagctactcacgggggctgaggagagaggatggcttgagcccaggaggtcaagggtgcagagaatggtgattgcaccactgcactccagcctgggagacacagctttttttttagagtctctaaattttttttaattaaaaaaagatatgtgtgctttattatatgaaagttacacctcagtgggaaaaaaataaaagtgtagaatggaaaagatctttatgaactgaaatttccaggacatattgttcagtggggaaaaaaaacaaagtgcaaagtaatatctttataatatgctacccttcatgtaagaatgaaggagatataagaaaatagtcatgcatttgttcttttgtgcaaaataaacaggagagatgaatcagaagtgaatgcagctggttacttagagggggtgggtgagaatgaagaaggaatgagagaatgggagtgggggatcacagatggaggggtggagagcaggacctctctgtgtatgtgttttgtatgatgctgacttttagaactatgttatgcttcccttactcaaaaagtaataactaattaaaatcagccaggacagtggtggtggcagtagggcagagacccaaaatggaatttaaagagtaacaaatgagcccaactctattgcaaatgcataacacagacatgctaaaagaagaaaagaactgatctaaataactttgaaaaacaatattttgactacatactagaaggcttaaaagacaaaaagaaatgtgtacatatactgtgttctagttaatacatattcttttcaagtggcatgtgagttagcaatttggggactataaacatgcatacacatataagttagggctgagtgagttcataaatatgttgagggtaatgagggacagatgttttactgttgaagaattacaaatacaggggaaggctagaatgaacactgtgatgttagactggaatcagtgacagtataaactcatggtccttaatatataaacataaaggtatatacatataggtatagatggttatatgtgtatgtctgtgtattcatagatatactgggaaatagccctgttctttgagagggttaagaattgacaccacagtagcaatgagcatgccaagctcccagatcttgttttctaaatcccttctccaatacaaggaatgggggctccttggaaactgcttattcccagactgaggcaagggaaatacacaatgttccagcaatatcatatggtgcctaaaattaaggaagtatttagaaaatgatggggccatgtcaaaaggaattgacagttaaaggatctcccaatgggcaaatctggggacaactggagcaatagcagaaatagcaaaaagtactaatactaatgaattataacccatagaataaaatgattatccatgaattcattactactaaatcaaaggagaaggtataactctttcttatcatagaactcccattattcaatgtaaaagaaatgaaagaaatagaatatcaccatttgcatgtatcacagtaataactgttcttgaagaagccatcaatgactgttaacattagctggtgaaaaaaatatgataaaaaacaggacatttgtacactgtcaaagtgtctcctcacaatatttttttatttcaaaggaaaaatagtaactttacaatggagaatcctggcagacacagccttagccaactgatcaaggttaatatcgccagtaataaaacacagtgacataatcatgtgtccccctgataacatgcagaggacacaatatcaattccttggcattcttgcaaaaaaacatataacctaaatttaataatgagaaaacaccaggaaaacccaaattgaggggcattctactaaaaaatttgctagtgctctttgtaaatgtcaagaatataaagaacaaagaaaggctcaaattggaggagttagggagacaacacctaaatgcaatgtgaagtcttgcatgcactcctggaccagaaaaaggacattagtacaaaaattgaacaaaaacctgaagaaaatctgcaggctaactaatagtattatactcatgttactttcttagttttgatcattgtacaatagctacataagttactaacatttttgaaagctgggtgaagggtatatgtactatataaaggtaattactttgtactaaaatgtttggcaacatttttataagtctcaaattctttcaaactgagaagtaaaataatatatttttgctttatgcacatatttaacagtttttggagaggtaggtagtgtatctgaatggcacctctcaaagtcaaatcctgtaacttcaaggtaattgacaccatgtgacttcaaggtaattgcttacatcctctatccctgatataattctccatctgtgcagtatttatcataatcctcattttacagaagagaaaggtgaggcagtgaacacaaagtggccaccattgggtatatgatgttattattattagaataagggatcagggaatgtcataatgcaagtgaaatcatccgtttcaattattttttactaagaacttcctcaccctatgaagaatcaaaggaagaagccagggacacagtgagtgggaaagtaaaggaagaaagaagatggaaggagaagggagggaggctcgagagagggaaggaggagtgaaagaataaagactgcctccttactgtgataaatgtgatcttcagtatcatcaacattaagccttcaaacaaaaaaaataatgtaaggactacatccctttattcattcctttctataccagggttctcaaaaagtatatcttcacgctcatacaattaagaggataattgctaatgtataatttgaattcaccatgttacttaatcactgtttcctcattacatcaatcacagtaattgatcatgatgataacaaatccatttccttcaggaagcaaccccaatcttaacctcttttctaatactatttatggaatcaccctgcccaagttttgtgttttctatctgaaacctaatttagatagatagataaaatgcatagatggatgatggataaacagatatggatggatagatagatagatgaaatggatagatggatggatggatggatagatagatagagatggattaccgtcggatgtatacatgcataccatcattggaagagtcaaagaaaattcttcggtggagtgacaccccactaatacaagtacgacatgccaccaaaatcaaaactactgtactcaggaatatatctatgcattcatttgtttatctgcattatatatatatatataaattttttttcttttgagacagggtcttgctctgtcacccaggctggagtgcagtgctgatcatagctcactgaagcctggaattcctgggctcaagcaatctccctgcctcagcctcccaagtaactgggaatataggcatgcaccactgcacccagctaactttttgtagtttttgtagatatggggttttgccgtgttgcccatattggtctctaactcctggcctcaagtgatcctcgcacctcagcctcccaaagtgctgggattacacataacatatatttatttaaacactcagtatgtaccaggttctaggtgctgagttgaaagcaaggatgaaaacaaagtccctgctcccatcaagaatactttctaatggagaagacagatatataaacaatgaaatctattatggcaagtccagacaggtgacataaagaaaaacaggctgggcgcggtggttcacacctgtaatcccatcactttgggaggccgaggcgggcagatcacctgaggccaggagttcaagaccagcctgaccaacatggcaaaaccccatctctattaaaaatacaaaaagtaaccaggcatggtagcacacacttgtaatcccagctaacctgggaggcagaggttgcaggcaacagagtgagaccctgtctcaaaaaaaaaaaaaaaaaaaaaagaaagaaagaaaatgaaaaagaaagtgtgataagaggagagggatttcagagaggggccacgtgggagtgagtgaggtcaagaaaggtctcttgaaagaataaagacctgtatgattatcttggggaaaacagtgacaagtcacgaaactgcaagtgcagagacttggagactggactgactgtggcagcctgaggagcagagagaaaggcagactgcttgctcagagggagagaaggaatgggaagcacatgaaagggagacagcagccacatcatttgggatcttgcaggccatgagaccccatgtatatcaccactggacgtacacatgcacaccatcattgcaagactccaatacaattcttggctaggatgacacaggaacttgcaaaaacccatgggaaaccagcctcctgttttatctctggagtccacaggttcctaaaacccaaggcagcctggaaacaggagttacgcagagctggaaaccttggcagagagaaaagccttcagttaagcgagactctccagggcgaggcagacttttttttttcctccctgtttttgttgcttttcacatctggctttcttgtgttactttcagaccatccatctatgtttgtgtaaaagggtcagggccacatagcatggaaaaatgtagctttctctgcttatttataggcccaggccttttaaggcacagatgcccaaagatctccatccctacctggaagtggcaaaagggcaatgacagtggagccaagccagcctcccagagtgtccaaaccttatttaaagcttttttggagccaaggacatttccctgaatctgttccaaactagaatgaagatgctggtgaatgatatttttgcaaaatctgcaggctcaggaattgacagtcttgacatttacgttaaatatgaagaaccatttatgaatccttgttgcagaaggctgctgtcagcaagccaaaaatacagcataaagaataataataataaaacaaagctggcacaaaaccttgtttcctcttgaaaaggccaatttttagtttgatggcagtgactcttagaacccaaaaggaaaacaaatttctacccacacggtctgtgctgctcttctcctcatgttaattttatctcacatctcaaatacatagtcatttttttcctattgaaactgaaaggtgttcttcctattgaaactcaacggtgttcattctaaaaataagttgtctgtatttaattccataaatggtttcttcctggtgagtgctatttttcaagaatgttgcttgactgaagttataataatgaattagatacagtctcttgcaaaattcttttgagatacaaagtcttcatgacatggaaactaattgcccattagctttgttcacatacttaataaaatatttccatgaagataataatcatcaaacttctttgcttcatgctgttcgagagctagaaattccttttttgcccccagtcaagggctatgcacaacgaaaactcatcaaatgcaagagccactcaaatcagctagtatttttaaaaactagaccgcaaatacaaatccacctgatatctaactgaaaaacatgtccctaacattttctaaacacttcattaattttaggcaccatatgatattgctggaacatcttggatttcccttgcctcagtcccagaataagcagtctccaaggagccctagttccttctattagagaagggatttagaaaccaagatctgtgagcttagcatgctcattgctactgtgatgtcaattcttctttcaactgataacattcatcttcacccccacggtgggcagaacgttctaacaagtgcttctcactcctttaagtaggcaacatcctgttagattttttttttctccctatcttcttgcccaaaaaagatggagaagggggcaccaacatggtgtgccagaagcaggtggcagcttccctggaccaattagccattgattggtcagatactactctgcccacaaagccacctctcacccaatctttctttagctgctttaaaagttcttctctagatttctaaacaaagacattgttcatatcttccaagaattttatagttttagctcttacatttaggtcttagattcattttgagttaattattgtatacgatgtgaagtaggaatccaacttcactctcttgcatgttgagcatccagttgtcccagcactattcttttaaaagcctattctctacccaacttaattgtattgactctcttgtttaaaattaattgactacaaatgtgagggtttattgctacactcttaattctattcaattcatctacatatttacctttttaccactaccacattgcctttattactataataagttttgactgtaagttttatagtgggtttagaaatcaggaagtgtgactcctccattttgatcttccttttcaatattgtttcggttattctgggtttgttatattaccagatgaatgataggttctgcttgtctacttctgcaaataagccagctgggattctgatagagcttgcactgagtctatagatctatttgggaagtactgccatcttaatgttgttaagtcttccaacccatgaacatagacatgggatgcatttccatttatttaggtcttctttaatctctttcaacaatgttttatagttttcagagcatacattttgcacttcttccgtaagattcaaaaatgctacagagaggaaatcagcaaggaatcaatggccatggggtgggggagagttagtgggacagagttctgttgtgactaactcatagctttctgccttgagagaatgcaaagatggtggtgccattagctacaccaggtgttttgtgaatgaaggagggtgaagtgggtgtcagaaatactgagtttcaggaagtgcctactgtgggtggtagtgtcccctagagtggctttggtatagaatttgagtatacatgttcaaggggaagccttggatgtggctgagatcacctggaaaaatgagaaaaccacagcaggaccaacatgcacaaagagacatgagtcagtggagaggctatacaggactaaggagcaagacagcagcaaaacccagtgggtattttgtcagtgtagctaaaataagagaacatgtcaagatggggtgtcgagaggaccctcaggaaggccagcaggaatcaggctgcatatgggggcccaagtaagcaggctgctgtctggtctgcttgccagtctgtgaacaccaagaaggcaactacaagagtagcccatctttacagcaagtcttcacacagcatggagggaggggagctgaatcagtggacacattgcagggacattaagtgagtcctggcccaacaagaagcagatgtccacgtgggattaagaaaatcaagatggtttcagagagaacacctctgtaaaagaaagggcaatgcaagtctgcccccacttgaaggataaagggagggaaggttggaccgctcttgactgatacacagactaagacaggttccaggctaccccaggggagttgtcaagccaatgtcagtcatattgggtcgctggctgggattagtcagtgagaaacatggcctctgcacccctgcaccaacattgcaagggactgcagagcacagtagctggggcccttgatcagttatgcgccctgcacttggagtctgccagattccgattcaaggctaccacatacatcaatatctggtctgggttttcctatgttgctggagaactcattagtagatgagaggtccctgtgtactctggaacaattgagagaagctgagcaaagacccaagagatgacaacaaacaaaagccaagaataaagaaagaaaattatgtttgaaaaggaatggagccttcatgcatgcctttctttcctcagaatttttttttttttttttttttttgagacagagttttgctcttgttgcccagctggagtgcagtggtgcgatctcggctcactgcaacctctgcctccctggttcaagtgattctcctgcctcagcctcctgagtagctgggattacaggcgcccaccaccatgccaggctaattttttgtatttttagtagagatggggtttggccatgttggccaggctggtcttgaactcctgatgtcaggtgatccacccgcctcggcctcctaaagtagaaaattacattttataccttctagaccaaacaccatgaaactaatataattaatttttttctcctggtagacttgaacaatgaattgggctaaaattatctcgccaacaaaatgcacacaataaaatgagaagagggggaaaattgcacctgattctttctagcacatatcctatcagccgcagctaattaactaaaggcccaattacctactgcgcaaaaactgtaaaggagcagagaagcctattctatgcagaaaatcttcatcataatgaaatcattagcttcaagaggaaaaagagttgtacttcaaacttgggaagcgagaagtgtctgatggcttgtcgaattacaagtttctattctacttgtggaaaaaaatattctgttaatgtgttttatgtgtcagatgaaaattgtatcacctagcacagcctgtcttacattctggaaattaatgttttagagcagggggattttttttcaacccagaacataatgtatgctttgacaaatgagctctcacttttgtcaataatattcaaagagtaagtagcaataggacagaggcagttctatccatgagagaacagccaggcatgctttattgcagagaaagaaagggaaaacagaataatattctgtacaagaaaattaagtttcaaaagattcaaatgtaatgtgtcaagaaactcttatttgcaagtggaatttaaaaggaaaccaaacgaaatgatggatgcatgtttcagcctcataagaggacattctcttctcctctttccttataaacagtatggatctgggcccactgctacaaccatcagacttccatcacagccagcatttgtgtttgaaagttctgtttcatcttccccacaccctgaccctccaaaaagttcagtaggaaatcatcctgggatcaggagagcatcaacagtcgctgttcctggtggttccagccactccccaccccctgtgcaaacaggctccagagctttgagttcttcattccccggggccctctctctccaccaaaacctcacagctttacatcccgtcccataaggaccaaatcccagctccgatataattagctccagccacagaatagtatgccgtaagttacacaaagatcatagctgtatacaaaccacatggaaatgtcttccgtacattttaaagatcttttccacatagcacagccttcttgcagatagtataatttacttatttgttattatcacatattgtctctccctctgctagcatgcagatccatggtcctgggggagctctgtatgctttatttgatgatctacctatcccacgccttcaagcagtgcctgggaatccctggcaacaggtgctccatgaatacgtgttcgatcaacatgctgagtgtgcttaaggctttccatttttactgtacagactttttagtagttttgtttataaccaacatatatttgtgcattcatagggaattctgactgttaagattttaaaaaggaaataagagaaataaaaagcctgctaatgacagtgagataatctattatcctctatcaatatgacaataagtgacaaagtgaaaatagtcgattcagatctcaaggacagaatgtaggattcccaggtcctgtctatgttcatacagaagatgtttggggtcaagcagagcctttgctcaactccacagaggtggcttcgcctggtgtgatcctctggagaagtctccgtttcagcctctccccattctttgggtttcgagacactaaccttcttgacttaataggacgcggctcatattgggaacactgccaacatacaagtgaaatagattaaacaatagtgtgctgccctcaggcttctgaaactcagatctaatgaggacattttcgtcttcatacccttaatgacctcctgttgcccacgagagaaacaccagtttttcagggtgggaaacttgcatggctctccagaacattctccagccattcatctccatatcggggttttcaggtgacaaatccttcctacctcccttccttgggtcactattcctcatgctcttccccttcttcgtgaaaaagagtcacaaatatgtcattcagtttgtcataacccctaaggtcactctttgaccaaaagccattcactgaaaataaaaaatggcaacagctatgtaccaagcaccgggttgaaaaacaaaaacaaaacaaaaaaaactttcaccggaattatttcattgtaatcctccaaaaaattctgtccacatgattgtcagagtacatatagaaggaaacttatgctcaacatgtaataagtgtgcttcactcaaggacagatgaagatggcaaacaaacgcaggaaaagatgttcggcatctttagccgttagggaagtgcaaattaaaatcacagtgaaatgccactatcttcctattaaatgggtaaattaagaaaaaaagaaaagaacaataacaagtgctggcaaggatgtggagcaaccagacttccatatattgctggtaggaatgtaaaatagcaccgccacttcgcaaaacagttgagcagtttttttataaaggtgaacacacacttgccatatgcagcaatcacacttctagagatgcatttatacaagagaaatgagaacttatgtccacataaagactcaattgcaaatgtgtacagtgactttatttgtaatcaccaaaacctggaaacaaccctgtgcccttccactgagaaatggacaaacattcaacagtaagtacatccatacaagggaatctacccagcaattaaaaggaaaggctagcagggtacagtggctcaagtctataatcccagcactttgggaggccagggcaggaggactgcttgaggtcaggagtttgagaccagcctgggcaacatagtaagaccttgtttctacaaaaacaattaaaaattagccaggcatggtggcacatgtctgtagtctcagctactcaggaggctaaggtgggaagatcacttgagcctaggaagtcaagctgcagtgtgctatgatcgcaccactgcactccagcatggacaacagagcaagaccctgtctctttaaaaacaaaaggagagagaaaggcctactgacgtatgtgacaacatggataaacctcaaagacactgtgcctaagtgaaagaagccagacatgaaagcctcatactgtctgactggttttatatgagattttgggaaaagtaaaactacgaacagaaatcagatcagtggttgccagaggccaggatgggggcaaggacagactacaaaggaatatgagagaatttggggaggtggggggatgacggaactgttccatatcatgattgtgatggtgattgcacaattatactggcttgtcaaagctcaccaaactatacccctcaaacagatgcattttactggatataagttatgcatcaataaaacttagtgtaaaaaataatcaatcaatcaatcagaagaaatacaagcacctcatcataggctataaggcttatgaatggtcaagctggagcttactcttgcaatgtgtctatttatctatttacaaattacctccaagtgctaatatcagtaatatctcaaagcacatatatgaggctaggaaaatagctatcattaatgaacttagacataaaactgcatttcaaatagtctcttgatcattttgattttttttctggtcagcttcttgccagacctgatgaagacaatgtttggacctctcaatacagtaaggaactcacatcaggaatacaaattgaccactttcttgtggtcacttgtgcttggagtattacccttaccttcagcaggttgcacatcttcaaaagtctttttaagctatttacctatgctgtgaaggtaggttttacataaactcgatgtcatctctgggttcacatgaccatacctgggtaaggcacaatacatgccaatatgtgggatactgtggggtgccccactctgcccttggattaattcttatttcatttctgacttgggacatttggcacatggctgggtgtgagcaccagtattgctctgtatagacattaataatgccaaagataaagactgttaacatttattcttttttttttttttcttgagacagtctaactctgtcacccaggctggagtacagtgacataatcacagctcactgcagcccccacctcctgggctcaagcaatcctcccacctgagcctcccaagtagctgggactatttgggaggcacaccctaccatgcatggctaattttttatttttagagatggggtctcactatgttgcccaggctggtcttgaactcctgacctcaggcaatactcctgcctcggcctcaattctttgttttttttgttttttgtttttttttttttctgagatggagtctcgttctgttgcccaggctggaatgcaatggcgtgatctcggctcactgcaacctccacctccctgggttcaagcgaatctcctgcctcagcctcttgagtagctgggattacaggcatgtgccaccacacccagctacttttagtatttttagaagagatgaggtttcaccttgttggccaggctggtcacaaactcctgacctcaagtgatccatccgcctcggcctcccaaagtgctgggatttcagacctgaaccaacacgcctggcctcaattctttattcttaaaaatgttctaatattttcttcccacatggaacaaattgctaccaacaccgcccaaattatattcagtcactatggaggcctctactcctattggcctcctctccctgatgcagttataagacctttcacagacgtgagtcctgtggccagtcttacataccatactggatccatcagatctgacattcattggtcactacccttttcccaattatctttccatcattgaaagcaatcttttttttttccctgctattgtcattttaggacatttcttcaagaatgacatttgtagaacatttccagaacatttccttaagaataatgttcagaaaaaaaaactacagtataggtttttttgtggacttctggaagcaagtgcaaatagtaggcaaatctcttcaaggttactgatgtcctcaatcctacctttcaaggctggcagtcctgcagtttcctttcctaaaactaaatggagtgtggaggctgtccccctacctctagtttcatgtccttcattgtgtcttgctcattaaaatccagggacctgtggttcatgcatgtaatctcaaaactttgggaggccaaggaaggaggatcacttgcacccaggagtttgagaccaacatgggcaacatagggagactccttctctaaaaaaaaactaaaaacttcgctgggcatggtggcactctcccgtagtcctagctactctggaggctgaggtgagaggatcacttgagcccaggaggttgaagctgcagtgaaccgtgattgcaccactggactccaacttgggcaacagagtgagacgactttgtctggaaaaaaaaaaaaaaaaacctcagggacccacccacagtcacctcctaggtcaggcctatttgcggtttcccactgctgtgtttagaccttgacattttctgtttactttttaagatgctgggtgtatgcctaagcctacgatgataaaataggattgctcaacttagcactattgacatttgggcaaggtgattctctgtggagggatacatcctctccactacaggatgatgagcagcaccccagcctctacctaccagataccaggagcaccctctacccatttgtgacaactaaaaatgtctccagacgttgctaaatgtcccatgccataaagttacccgctttacttacaagaagcaccaagatcctaacaacttgggctgctgtaaccagagaataactaccctattgaatttgccaacaaattgcaagtaaccccttgcggacaaaaatttcttagtgtaagggaagtattcattttcctagagaagacgagaaattcttcctttctcacaagaaaaggaaaaatgacctgcaggcatgtgctctgcttctctcaagaagcgcctccgaggcggaggttgcagtgagtcgagatcgtgccactgcaccccagcctgggtgacagagtgagatcctgtctcaaaaaggaaaaaaaaaaaaaaggaaaaagaaaaagcacctcctaaagccctctgttccttcttcgccaacattcctcccagagatgagggctccttctcacttccacatgcaggggacaggtgggccacacccaaaaaatccttccatcttcaccccatctgaactgtagagataacaatgctaagtgccagccaggcacaggagctcatgtctgcaatcccagcactttggaagcctgaagtgggaggatcacttgaggccaggagttcaagaccagcctgggcaacatagaccctgtctctagaaaaataaatgaacaaataaataaaaataatatttttcaaaaaatgctagtgcctacccagggatgtaacaaggattacacgagtcattatattagagcatttgtaaaagcactattacatataaatataataggataacaccattatggccagaaactaccgggactcaatgactctatcacactctggctttgcatccaccagagtttactaagcacccgcaccatgcagacactgtgctaaaccagtgtcactgcattcaagaaggttctagtctgtgaggagacagggatgatgaaagtttagacaaggtgcagacatcggtgggaggtggtgcccaaacttttctggaagagtcggggagggcttcctgtaggaggcagtggttaaactgagacctgaatgacgagagggaattttccaggagccaaggagaatgaagagcatttcattcagaggtaaaaacaatgggtgaaagtccaagggcagaagggaacatgacattttcaggaaattaaatttccaaatcaccatcaaccaaaaatataatcaggggagttacagaaaagaaggccaaagagcaagttggggccagctgacatgcagaagaggcaagatcagccaagtccatgggaaatgctaggtcaaacctaaaggagtttaaagtgtcaaaggtggtggtgagtttccaaaaggaaagatcataagcagcagttctcagatgtcggtgatgatctcggaagtccagggttcagggttctgaaagggatctgggttgggaaacactgctgagagaatgacaagtcattaaagactgattagataaaggaatttcatcatcaggtgtgcatgtgacagatgtcactctgacctgaccagcatggagggactggacaggataggccctgaggcatggaaaacacaagataccctggcaatatcccaggaagggaaaggctaaacccaggcacggccatgggcggtgggcatggaggggctggaatgcctcagagagacactgagacggagaggaacagagacaccacatttccaccttaagcagcaggtgagatggtggaaccatccagagggagaaatcgtaggaagaaactggtttgaggaggaagacaaggatttccagttaagtgcatagagtttgaggtgcaagtgaactatcatgagtatatgggggtggaggctccagagacttggactttagatataaattaaagagtcagtgatcaagaactgggcagaaactactggcatcaagtggttctcaggatcacctggggggctgcttaaaaccccgagcttctgcttcatggggtcccaggtgatgctgatgttgctcatctgggaaccttactttgagaaccacagctctagataaaagaatcctgccctttctcctctactttggacagaaatgataggtaaggaaagcataaatgtttcatctttttctctctctggcccttgaactccagaagatgggagtacttagtttgactgcattcttattccaacttcaggagcccaaatctaccacaatttgccaaatattagaagagtatggactgtaagacacacctgtaatttgagtaatgctaagaaggaaaaacagataccaataattatgagatgtggctgattgaaagaagcattctgattttcaaaatatgaaaggctggaaaatgtgcattttagaattgaccaaaagtggtcttccctgtcctctggggccaccctggaaaagtccaagcagaagcctgtgcaccagcaggagccaggatcctggatcttcctgcttttttgcctgtggtatataccaccacatccacaggaacctgccacacacaagggctttgctccccataagatctcccagcaacagggtccttcacccaaaccttccaaaagtgcctcatcccacattcccagattctgcagaagctctcaaaactcatatgcaaacatgcaaggacatttaataacaactcctgcatttcccactttcacccatgattacaagtagtcatacccagggtgttcttgctcagagagcctactacagaaaagacccaattaagaaacaccattggccagacgcagtgctcacgcctgtaatcccagcactttgggaggccaaggcgagcagatcacttgaggccaggagttggagaccagcctggccaacatggtgaaaccccatctctactaaaaatacaaaaattagctgggtatggtggcacacgcctgtaatcccagctactcgggaggctaaggcatgagaatcgcttgagcctgggaggcagagattgcagtgagctgagatcatgcgactgcactccagcctgcatgacagagggagattctgtctcaacaaaaaaaaaaaaaagggggaaggaaggaaggaaaagaaagaaagaaagaaagaaagaaagaaagaaagaaagaaagaaagaaaagaaagaaagaaagaaggaaagaaggaaggaaagaaggaaagaaggaaagaaggaaagggaaaggaaaggaaaaagaaacaccactgccaaaaccagcaaaagattaaaggaagcaaacatcctcattctactatttcccctcttatgcaggagaaatagcctgagttgcacatattaacccatattgtcttttttttctttccaaatttttaggttcaggggtacatgtgcaggtatgttacacgggtaaattgtgtgtcacggggatttgctgtccagatgatttcatcatccaggtagtcagcatagtacccagttgatagtttttcaatcctcaccctcctcctgccctccaccctcatgtaggccctagtattcattgtccccttctttgtgcccatgtgtactcaatgtttagttcccacttataagtgagaacatgcagtatttagttttctgctccctagcctgacaccgcccaatgtccacggccaaaatacttaggcaaagcaaaaagcacaaggggcctttgcacctaaaagacagtgtcttccattccagtctgaaagaaactccctggaaaaattggagcaaaatagctctgtccttcccagggtctcagaggcctcctctctccttggagagtattctgcctgtctccctgggctccccttttcttctcagaagtacaagttgaagggaatctctcaagcttcaaggagtgtccaaagtcaagcatctctgttgttgtcaagctgcaataatcatgcttccatctccaacatacccttgtaagaagaacactttacatatgttttacaaaatgtaaaaatggctatgtggaggtctagcagatcagaaacagcagaggccaagagtctacatgtcgagatcctttctggctctaaccccaaggccacgcttcctcccagaggacccacacctatatgtagctactgctaaaatgctctcacccgggcagctcctgacagagaggcccaattcatgacatgccattatcgcagcagacgaaatttcaaccaaaacaaatctgttatgcaaacagttaccaacataacttagaagggtattctgaaatgacaggcagggaaacctgacccctacctgaatatcccaggaggacgtccagtagtagcaaatcctccaagagggtcaaaattgcctgctatttttaaaacctgaaactttaaataattccagaccccctccgccacatgttgagcaatctgccagatcagttatacacatggagttgagtccaacaatctgccaaagaagggagtctcccaaatctggccacttctcatttccatatggaaagaattaccatgactgggcagagatggagggagaggggaagaggaggcgggagaggtggcgatgattccaaggagctgatccctattataccatgacgtgtgcagcatcgaacgtcgtcactgcaatcatcatttcacatatttaaaggaagccttcaggaaaagtttgttttattcttttaaagatagttaatacattcattggagtttttgtggttgttcttagtcttgttctcattctgtacataagagtttttttttggtttttttttttgttgctgttgcgtttttcgcaaatctgagagtaattagtcctttgcattcaagctctggtatttggaaaattcagcattcttaataggttgactttgagctacctttggaaattcagctccccaacatgcaggaaaattctgacacaacatctgttttccagtaagaccctgttttgacacaatttgatactcatttgcattgccccaggtgttggaaggtcaagcaatagatccaaggtcacactgaaaatgaggctcccttttaatttcctgcattcttcctgaatggtttcaagagtaaatgggttccaggaaacctgaggagaaagaatgaaatcactgcaagactatccaagcttcccatgtttggtttggttagaagacatttttaaatagagcatcattcacacggtcttcttctgagtttagataccacttttcaggttctctctggaattccgtaaaattttgcagctcatcagaatcatcaaccactctccccttgttcggtgcaattgccaagtctatttataaaaagcacatgctatctgaacacttgctactcaaagtatggtctatgaacaagcaccatcagcacttgctgggcacttattcgaaaagcagaatcccccttccccaacccctgatgtaggatgtcataaaacactgttcccaaagtaattgggatgcactgattaagccaggggacagcatgctacaagcctgcaggccaaatctggccactgcctattcttgtaaacaaagatttgttgaaacacagttagaggcattaatttgtctatgcttacttttgctgtaatggcagaattgagacatttcaacagagaaagggtggcccacaaacataaaactatgaattatctggttcttaaccaaaaatcttcactgacactgatctaaacctttattctacagggaggaagaggaaggatgaagaaaaggaagaaggaggaagaagggaggaaggaggaagcaggaaggaggaaggaggaagaagaaggcaggaaggaggaaggaggaagaagaaggcaggaaggaggaagaaggaagcaggaagaaggaaggaggaagaaggaaaaaggaaggaggaagaaggaaaagggaggtagaaagaaagaggaaggaagaagaaacaggaaagaggaagaaggaaggaggaagaaggaaggaggaaagaggatgaagaaaaataaaagcggaaggaggaagaaggaagcaggaaggagggagaaggaaggaggaagaaggaaagatggaggaggaagaaggaagtaggaagaaggaagatggaaggaagaaaaaagaagaaggaagtaggaaggagggaggaggaagaaggaagtaaggaggaaaaaggaagaatgaaggaggaagaaggcagtagaaaggaggaaggagggagagggaagtaggaaagaaaatggaggaagaggaagtaggaagaatgcaggaggaatcagggaaaaggaagaaggaagtaggaagaagaaaaaaggaagacaggaggaagtagaaaggaggaagaagttaggaggaagaagggggaaaaaggaagaagaagacgaaggaggaggacacactttttacacaaagttctgctaatttaacccttatgtgaaacagttaaatagcaactcctagtgagacagcaggcggaaagatttgaaggaaaactgttgctgccacaagggaagtttgatggcaggacttggagtgtgtatgcatgatgtactaattgaagcattagtacagtttctttgggggggtgtcagatgagtgtagaggaaccccctactctccacctttgcctagggcaatgtctgcatcagagattggtgccaacgtaataatcagcctcacagaaagttggattcagagtctggaaagatggaagatacaatctttacagcctatggatagaccctcctttccaaacttcagcgtttggaatcttagtacaatttctataccaaaggtgcttgccaaatgaaactctggatttacaacaaattgtgttttgaaaaatactgtatttgccaggcgcgcagcggctcatgcctgtaatcccagcactttgggaagccaaggcgggtggattacgaggtcaggagttcaaaaccagcctgaccaatatggtgaaaccccttctctactaaaaatacaaaaattaccgtggtggcaggcgcctgtaatcccagctacttgggaggctgaggcaggagaatcgcttgaacccacagggcagaggtcacagtgagccaagatcgtgacactgcactccagcctgggcgacagagtgaggctccgtcagagagagagagagacagagagaaagaaatatttaaattgctccagttcaaataagccggtaataagccaaaccacctgtctcatagagagctggagagagagaagggtcagcaagggaaatgataaaataaacaaatcactgctatgaaaatttatatggctcaccccgcctctgaaatgagagttcaaaatagaaatgcttgctccttaacacgggttatcataacgagatgcatttaatacatgagtttgctggataccatggttcagccgtgctgtattttttttccatgatagatttgaaacatccatcgcttcatttgctgcctctttccacaaagcagatactggagagcaaatctcatgcagatgatgttttgtctagaggcagcgagctgttttataataaggcagatgtagaggatgcaatttcaaacacacacccgaaagcacagggctcactacctgtaactgagaaaacgaggcagagatggatgccttgtttgcattcatgcaggacacatgcagaaagttctgtctgccagctacgggaggaatagacaaagcacctcccaccaccaggcacaggtggagtggcggaggacggggcggtggcagtagtcccacctctatgcacagagttccatcttcacaagtaggaactcaagcagttgaagaccagcagcaagctggccatgcagccgcagtgtaaaaatggacggcctctccgcacactatagacagtcccgccttgagcaaaaaactaacatacacgatcctttccaacctgcagaacctgccattccaaggggcccaaaataaccaaccaacaaaaataaacagcaaaaacaagccaacaaaaactttagtgccttagaacatcttcatttgcctttatttttcctctgcttttcatttaacagtgctctctttttttcagaaaaataattagtgacaaaagcttggtatactttagaattgtagttaaaaggaaaaggacaccccaaatggattgtggccttcctcaattctgacttttcttaaaatgaactcattgcaatttagggaagaaaaatgtagatttttccatctttcactacagagcatgatgctgtgctgatgacggtggcgttatatatatgtatttgtaaatctagaagagtttgacgcattcctaaagaataccaagaatataatttttaaaacatagaattaagggcgtggcaaaatggctcacacctgtaaccccaacactttgggaggatgaggtaggaagatcacttgagcctgggtgctcaagaccagcctaggcaacacagcgacatcccgtctctacaaaaataaaactagccatgcgtggtggcatgtctataggtatatagtcccagctattcaggaggctgagacaggaggatcacttgagcccaggaatgcaaggctacagtgagctatgatcatgccactgcactccagcctgatggagcaagaccccccgcctcccccccccaaaaatagtagaattaaggaatcttcctgcctggtcaattttttccagatgtctcctgctttttcctctccttgcctggctataaactttaaagcaaagaaaaactaattctagaagaaaaatccaggagaaatttcaaacaaaataacatgtagaaatattatattcaagagctaatgcggagctgtacacaaatagataatgacttgaaaatcattacaaatcaagaagaatcctgaattatcttacaaaagaatcacactcttgaaacttaccaacaacgtcatcacactattcctgttaaaatatgtacacaaatcccttagacactatattcattttctggggctgctgtaacaaagtatcacaaactgggtggctttaaaagccagaattgttattctcccaccattctggaggccaaaagtctgaaatctaggtgtcaagcaggattggttcctttttgtcctttttatgatacaataggattgatttttgtttgtcattttgtttgtttgtttttgttttgtttgtttgtttgagacagggtctcactctaccaaccaggctggagtgcagtggtgccatcgtagctcactgcagactccaactcctgggctcaagcaatctccccacctcagcttcgggagcagctgggactccgggctggtgccaccacacctggcaagggttggtttctattgagggttgggtgggagaatctgtcccgggcctctcttcttgcttctggcagcctcaggctatctttggcttgtagacatcttccccctgtgtgtccacttcgtcttccctctgtgtctgtctgtctctgtgtccaaatttcccctttttagagggacaccagtcatattggactagagcccaccctaatgacctcattttaacttgattacctctggaaagacactatttccaaataaagtcacattctaaggtcctgggggttaagatttcaacctatctttttcagggtaatgcaattgcacacatataatcactatatgcctctattctgtgtattctaagactcaaaaatagattatgctctaagctgcagtaagttcatgttggaagaagtcaaaggatgactctcctcaaggaacagatccattgatgatgaccaaaattcacatacatcatcattcgccattgaatgcatttgcaaagtaccccaggatctttccactggcagcctctccttcttgtagtgtttagaaatccacttcggggaaaaaaaaaaaaaaaatgctttttcctccccagtgagccagtctataaaagctctcaactaatttacatctgcaaaagtagatcacatcagacgctaccaggctttccatgcctccccactgggatttggcctcagcctcacacagctgtcttacaggtggcgcttgctgggccctgccaccccacgtcccctccagccatactatgctctttgcttgctttacctcaaatgtaccttgcctttccacggccctgagcctgtgttcaaactgctccctggccttgacatttttgactttttttctttacctattaaaatccttcaaagtcccgccaggcccagtggctcaagcctgtaagcccagcactttgggaggccgaggtgggcagatcacttgaggtcaggagtttgtgaccagcctgggcaacatggtgagaccctgtctctactaaaaatacaaaaattagctcggcgtggtggtgcacacctgtagtcccagccactcaagaggctgaggcaggagaatcacttgaacctggcaggcggaggctgcagtgagctgagattgcaccactgcactccagcctgggtgacggagtgagactctgtttcaaacaaaataaataaaaaaataaataaataaaataaaaataaaatccttcaaagtaacttccaaggttctgtcctctgcagagacctttctaagccacctggttatgattctcctctcctttttctgttttctgctttcctttcccccaaggaagcatttcaattcctctgcccatgttatgtcagcctcctaccatctgccgtcctgaccacaacatcgtagcctccctcctgccatgtctccataaccccatacaacccagcatatagcaagacctcgagcaagcactactggctgatggaatgagtcaagagatgggggttgttgggcagagcccagtagagttatccagctcactgaaaatcccaggctttccaaggaaaaggtttgggatttattttccttagttcatagtctgtgctttgaggattcagcagaacaaatcagcagattagtaagtgggcacctgacatccagatgggaagaaaccacactgctcacaatgactatggactcgaaactgcattttcaggataactgtgttctggactgtatactctcatgaaaacacaagctcgcttagcaacaaccagagtagttggaggaagaatgtgaaaagatggcagaattcatctacaattcctccgatacacaagagtaattagccagttttcaaaatttgtaagtatcacccctctgaaatgctggatgaggaaggcaatgatcccaagctttttctgtttctctctgcctgcactggcttgtctattcttccctatttggtaaaagccaagatgtctcaaattgcagctctcttcctgaaccatccagcctggagtatccccttccctgggccaaactattttcgagtgcctaagggctactcccctaattcactgtctgcaatccttagttatctttttcctataattctgtttaaatggcttaacttgattaagagttccttgaagacagggactacatgatgtgtctttgcatctttcgtttatctaaaatgtctccaacttcagctgaaactgaaagtagaaacccaaagctttcaacagtgttgaaacatcttctcccgcccctatatgcttcaagaactgctgagtaaattaaagtgcacatctgagaaggcagctccatttctccatgtccagcagagctagctagtcaaggtcgatagcaggaaagaaaaaacattgtgataaacactattaaatgtccaggctgaaatctgccgctaaagcaaagcaaagctttccaattacaaacttactttgaactcctattttcatttccgacatgtaattattactaaataaaccaggccgagtgaattaatacttttttggaatatagtcaagaaaaactataagtacaatattttcagtaaattatttacaagaatgggaaagggaggtgtcaagcattttgctctagtataatgtattggaaaattagttacagtgtctattagattcaaatatgaagaagattacatgtatacatatagatatggatatatgcatatatacatgtgtatctacacacacgtgtgtatgtgcttgttcatttcggatcaagtttaccatttgggtataattacttgagtttgggcagtggtctctcgtctcaccttcagctgtaagtactgaacatggagccctgtgaggaattccatttgggctttctacagttgaacctctcacccctgtagttttacaaagtgtcaggtaattttaatatttggagccgtctctgccctcacactcttagatcacatccctcccttacagacagcaaggggtccatcccaccctctggttggtttcatccctccgtgtcccgtggcctcaaagtcacagccaggggaagtacagtgggcagtgggcccagcctgcatgtgacctccgtgtctccatgtccccctgtgcagcccagggtggtaccttctctctggcattttcagggaatggctaagacctgcaagtccctgaggggctcatgtgttttcttctccccatcccagcctctgaaaccccttattctataggtatctgggcttcagtattaatgcgcttggtggaattcacttcaataaacttaggggagcaaaactacagctcacaaatggacttctagaaaaaaatgtccacatatttgtttgacccaccaaacaaatacaaaaatgctaatagtgacactttcacaactatatcaaggagccaatggtgtctggtggtgtgacaaggtaaagcaatgccctgcagcaatgcaaaagatagctacgaacactcagagtgcaagagctggagatgtcttctgaagggcaaggaccgtggctgaccaaggaagaggttatctttaggcagacaaccttgaattacaagaggcagctatgtgcccttccttcccatacacaaaacaaaccctagctggcatcaacaagaactcaaactacccttgattttttttttaattgtacctgtaaatcctgacttgaatgctttccagtagagaagtgtggtaaactcaggctgtaaagtcaggaatacttcctcccaagtgcatttaacttcaaatggcttccccgtttctctagaatagagacatgcagaagcttccatctggatgcacaagtatccagacgagacttgtactccagatgcacaggcctcatcttatggcttctgtgctgtgaggagagttggcatctccggtgccccagatggctcaccatcctaagggcctgaaaccgaggaaaatgtgcaggcaatgcatacgcgccaacttccagtgtgggagctcagtgtccaagctcagcccctgtatgcttaagctaaagtcccctggctctctggcttgactggaatctacattgcatttccccaaggtcagttcctgcaccatttgcttggcaagccattttgagccactctcatctcatcctggacaggattttggtatccactcgccagcattatccagcataaccacagctgaggaacattcagtcctctgccagtctagtccccaaaggcctggccatgtgggaccaattttcgggcagatggaaacatacattctgcagctgcacaagggtaaatcttaattacagccctcagtctggagtgatcggcaaccagcgtggtcaccttttcagacttccgcctatataagctctgatgaaatcttagagcacataagccttgctgttcagaaagacaacatgagggcaacatatgcatgagtgtgtgtgtgtgtgtgtgtgcgcgtgcacgcacacacatgcacgcacacacacatactaggtttccctttctacctaactcccggaaacgcatggaagcccctctgcatccagacgtgatagatgtatatttatattctatttcagtatgctggaccttccgtgtgattctgagttgcagcagcttaatagggtacaggaggagttttcgaattgtgcccttagcaggcaagtagacagctccactgtggggcacagaagcaagtgtctctgaagtcttgggcgtgctgaaaagaattctgtgaagaaatcgcaattcatctcttgtgacactacacacagctgtacgcacagccccttttgtgtcaggaagccccaggattcctgagtaaacagttgaagagtgcaggtaacaagagaccattcatcacttgaaacaatttagaatatcttgaagtgtgctttagaaagtaatttttttcatttttgaatttaaatatgagagtggcaatcttctcaaatcactaacttcaaaatcaatttgtatctttcagaatcactccctaaacaaaacaaacaaaaatgcataatttacatgaatgttcatagcagcattattcataatagccaaaaggtggaagaaactcaagtgtccatcagaggatgaatgaattcacaaatcgtggttcatccctataatgggatactattcagccataaaaatgaatgcagtgctgatacacgctgcaacatggatgagcctggaagtaacatgttaagtgaaagaagccagtcacaaaaggatgaatatgatatgattccatttacatgaaatattcaaaatagcgaaatccacagatgcagaaagcaggtttctggttgccagggattgagggaaggagagaatggagaggaactgcttaacaggcacggggttttctttggggatgatgaaattgttgaggaactagacagaggcagtggtttcacaacactgaacatatgaagtgccacttcattgttcacttgaaaatggttaattttattttatgtgcatgactgaaaatgtatgaaatacattttgctaagtaatctgtgaagtctttgttccaaaggatttagggtttttttttttgctttgtttttttggaagaatccatttaagatacctctaaagtcttatattcatgacacttttttaaatgcctcttggtggattctgagaataagtggttctaagaaacaaacaaaccaaaaaaaacctctaccctatggagctggcaactgaaaggcaaaaacagttgcagtttatctacccaaaatcaaataaagtaagcagagattaagacacatagctgggccattatatgtggattaatgcaaggaatctgacatttttccaggtaaagaaattgagacatcagtatagccccaggcttcttaaagcatggtccatggaccaccagccttggcatcaccccagagcttcttagaaatggagggtctccatccaccctagaactactgaatcacagtctgcgttttgacaagattcccaggggatcctcattatagctagagaaacagtcaaccggcccctctccctgaagttgtatgattttgccttcaacaaaatgcctctacagggtctctaaaatgcatgttccacaaacatggctgcccaaagctccccacctcccctccaaggcccctaagactgttctatcctcctcccacgcctgccccaccagacacctacaatgatcaagaccatcaagccctgctgcattacttagaaacccatcagaaccttctaacccagtttttaccaaccaagactttgccttcatcctggaaagtaagtccttcctcttcctccatcctccctcaactggtaaaaaatccaattggttctatgtcaggacatctgtttttcacaatgctcagacattaccaatctccttatctctttccaattgttttttttttaatttctttttcgagacggagtcttgccctgtcacccaggctggagtacaatggcgtgatctcggctcactgcaacctctgcctctcgggatcaagcaattctccctcctcagcctctcaagtagctggaattataggcacccgccatcatgcctggctaatctttgtatttttgtagagatggggtttcaccatgttgaccaggctggtcttgaactcctgacctcagatgatccacccgccctggcctcccaaagtgttgggattataggcgtgagccaccatgcccagactctttccaacttttatcacccacaaagaatcacctctaatgactggcgataggcaaaaaagcagggttccgggtggctgcagaggaaagatgtggtggctcagatgtgtgtactagaggtattgccgatccccatagattggagtgggctggagagaaaaacagactcaagaaggactccaagatgggcccaagctacaagaaggagggagattcccatccctaagatgagaaaggaaataggaagggcaagtttggtgagaaattcaaagcatgctaaaaaatgttagaaacaggccaggcacagtggctcaaacctataatcctggtgctttgggaggcccaggcaggaggactgctcgagatcaggaattcaagatcagcctgggcaacatagcgagaccttgtctctacaaaaaaatatatatatatacacatatatatgtatgtatatatatgtacacattatatatatatatattatatataatatatatatattagttgggcgtggtggcgcacgcctgtagtcccagctactcaagaggttgaagtgggagaatcacatgagccttggaggtccaggctgcagtgagctgtgatcacgctactgcactccagcttgggcaacagagaccttgtctcaaaataaaagaaaaagaaagaaaaagaaaaaaatgctagaaatatacatgcattgcaattaggtgtgtgcattgccttgtgagaatttccactcaaggaaccgaccatacttgccccttctcacaacgggctctgtatttatggacacatggctctcagtcattactgcatgcatgtgcacacccacacatgtgagagaatgcaatgtgctaactgcattcagacatagccaggcccttggggctgcttttggagactctctatggagactgtaggacgcttcacgctgagtatcaggtgactagagagaccaaatgagaaggctctctgcaatcacccaatttgacgcttgagaagattacccataatcttgagttctttatttcagaaagcaaatcaattggcatctggaaaaacaagagtactacatcttgggggaaaaaacaacaaaactcagcttctgccttgatagaatagatgccaggaaccatatatgtgtgtctatatatgtgcgtatactataaaattatagaattgtaaaatcagattttatttattatataattacattatatccaatattgtataatacacaattaaatagttgttggaggtaagtatacataatacataattatcaaacataattatatattttgtgtaatatgtaatatttatatttttatataaaattatattctgcacttgtacaatgtgtattatataatatgtatattaatgtataatgaccatgaatatgtctttactagcatatacaatagccattaaaaatcaccaaaccataaaatgtacataactcccaaattaatgcctcacccatggcagcctacctgtcctctagatgccacagacaatgtggggctgtccccaagggacacagtgaccaccagtcactcttcgctcttgaaatgactcacatttcctcacccacccccagctttcccttcggctcacggaaccaggcccccaccacccacttctgtgccctttaaatgtattatttcctgtgctgttactcactctctcgaaagtttttaacaatatgaggaaagtggatgaataattcatccgagccccgtaaatgactctgcaagacagaacgcaggtgtagcatagagagggccaactagcagataagcactgggacacaggccccctggggtgccaggctagaggaagttctaggaggtgagcagcaaggaccagccagaggtcttgagtgaggtgagtgatttgggatgccagacacactacgggtgagcatgaggaatgggagtcagctccttcccagcaccattttgttaagtatatcttattttcacaagccaaacctgtatttgccagggcaggataactgctggaacaaacagcctcagtggttcagcacagtgagtgcttacagacagtcctgacttacaatggcttgacttacaaatgttcaactttattatggtgtgaaagcaatatatattcagtagaaatcatgcttctctctcaatgctgggcagcagcaatgagccacagctcccactcagctacatatttttggcataatgatattttcaacttatgatgggttgatcaagatgcgactacatggaaagtcagggagcgtctatatttcttgttcacgtaacattccaatgggcaagttcctgctctgatggtgctcctgggcacctttcctgcttctgacttttggacctgccacattctgggattataaaggattcgccttccaggcataccaagagggaaagagccagcatggagcattgctcaggaggctgtttggggctgggcctgcagccagcataggtcaattcagccacatcccactggacagagcctaggcatatggctacacagaagtgtcagagaaactgggaagtgtggtgtagccgtgagcccaagaggagaaggacacaagtgtgttgggtaatgaggcagcttctgtcacaaggcaccaaggagtgaccacaaagacaaggaaatcaggcagaaaactgttataggggaaagagctttttagaaatggtttacccgattccaggaaagtctttagaactaccactgctctcttcacccaaacttaaatcataaagaacaacaacaacatgataataacagtaataataaggttgggggaatgcacctaaaaaactggctaaatccacactagagaggatatgcaatgaattagagattatgttatagttgtagtgttggccatcaaacccatcaataactaacatataagagcaaacgttagttcaagtttccctgtcttggtggcaattcgacccacattgtctttccatgtcctggttgttctagctttgctacaattccaagccagtggacagcaaaccacagcctgaggtcacatcccacctacctgctgttcttgcacggcctgcaagacgagaatggttctggcatgttcaaatgattgcacaaggccgggtgcagtggctcacacctgtaatcccaacactttggaaggctgaggtggaaggattgcttgaggccagagttcaagaccagcctgggcaacatagcaagaccctgtctttacaaaaaatttaaaaatcagccaggcttggtagtgttcgtctgtagttccagctactccacaggctgaggcgggaggatcgcttgagcctaggagttcaaggttgcagtgagctgtgtttatgccactgcactccagcctgggtgacagagtgagaccctgactcaaaaaaaatttttttaatttaatttaagaaaaaaaagtaagagtttgtcaaccccaggtctaagcctgattgctttctgctgttaaaaactgatcaaatccactgtttggacttctcagggtacagtctatttgacgtccaatcttttcattgtctctgcttaaaccgaacaacaggtgagcaactcttcctggacctcccttgctcttgctgttcctactgcatcaattcatacagcatggaaacctccataaatacagcatctactgacctgggatgccccttttgtttttgatgtctgaaccagggagattttgctaaacttcaaaagtcttaagcagaagaagaaatatttaggtttgtgcatgacgtggaagctttcccatcatttctttaaagggcttccctataggctttaataggcttccctctattttctatgtcccatttataaacaccgccactcccggctatagcagttgggattcaaaactacttcctccgctggtgatttatcatttcactagtttatactcatcctgcatctgttccttagggcggccataacaaagtcaaagccaagatttactcaagtctgaattcaaagcccaaaataattccatcccatgagctcattttcccagcactttctctaccccaggataaaatgccatgaatctatttactatccccacagtccttatacagatccgctgatttcatctgatattttctgacctatgggtccttttctctgcctgaaacaaaatatctacttaatctttcttcttcggtcttcatcaagtacttcatcaagtactttaattcctaaattcaacgatgtgactcctttactctcctctgtagctaacagaattacacagaaaatcctgcaattaataatagccattaacacctttttacacctgtgtagagttctgtcatttattttatataaatatatatttcccactggttttaacccacagtgaacctgtcttgaaatacagcctcccgaagacccctccaggttggccacactacctgggctcacttctacgggcccaccttgctgtgctcaggccaacacaccttcctgagcctactggcaactcagcttcccacatcacactgattacataattatgcctctggcaacttttattgtcatttgtaagtggctactattgaaggaagccacacatttttcctgaattttaggtcatttttgctctcccagacacagcttccatttggactaccaagaagtaattgtttacctccacaagtttccatcatgccatacactaatggccgactagttatgtaatcattaaacaaaatcctcaaagcttcaaggtatttcaaaaaaatatttttattataaagcgatggataacccttagctaagttatgagccaattcctattttgtaaagttgtgaattctattacacaatggttacctttcatgggagaaaagacagagcactattcgcgtccaaatgcagaaactggaagcaatgcaaactaccaaattgtcttcagctaaaacaaaaaccaaacatttcataattgagccaagaccctaatccaactcataacagtaaatcagtggcacagatggtagccatggcgaccttattttggctctatataatctacatgtcagatgtcgcacacgtgagatgggatgttagagtattaccaaaatagtgaacaatgggctcacttcagattcccagattccttgaccttaaatttaaactacccttttaaatccatctgaaaatattcaagacagcactcaggcttcctgatttatgctaacaatttgatcgtccttcccttcttttagcaaagctcaccacatttgaatacactgaacgtttaaccacctcaacacatttctgatcaaagcaagtgtgaaataatttctcccgctttgtacagcaaaattctttctgcaagtaagtaagaggagataatgcaattcaaaaggcctgaagactgggcttatattatagaagatgtatttgctaatataatcacatgaaattgtttcttttgttttcttaagcctcagctgggagacagtggcaactgaaacagtgttctcacattgtatcctgatcttcaagatgctttacaaatgaaattactttctgataatgaaatccactagactgtgggagagcctattaggagaagccccatgatccccctcactgctttgggccatttcaaagctgatgctcaggggcccttccctgactctggaaggaaagccaacgagcagatcctgcgtggagagagggaacgcggaagccctgtctcccggccttgtgctttaacatccaattctcattatttgggcctccaggggcaaggagctcgcagtaccggggaggtgaaacaccacctgaaatgcaggaaaagtctggagtttgtcgtaaaattttaaaatccgcatccttcctatagaattgtctaagcttcaactttttcagaagaaatgttctgatcaggaataatcctagtctaactgcaagtctttaccaaagcgggcaggcaatctgaacactctcttgcctatgccctgctctcccatgagtcgttggagtttaacttgcattttccgccccgttcaattcccttggtcctgggttgagtggatcttgtgagagaaaaggacacgaccccagaatctgcagagagtgtagagttttccttggagcaatgggtcccatactttagcagcaagtatatcaggatcccttggaagtattttttttctttttctttttttcttttttagacagggtctcactctgacaaccaggctggagtgcggtggcacaatcttggctcactgcaacctcaatctcctgggcttgagcaatccacccgcctcagcttcccgagtagctgggactacaggagcacaccaccaagcccggctaatttttgtattttttgtagagacagggtctcactacgttgcctggtctggtctcgaacccctgggttcaagtgatccgcctgcttcagcctcccaaagtgctgcaattacaggcgtaagccaccatgcccagcctagaagtgtcgttggaaagggccacccacccaggagttcctgattcagcaggtctaggtcgggcccaagaatgtgcatttctaataagctccccagtgaggcagatgtggccacagagagcagcacttttccagaaccgctaacctggagtttaattaaataagctgtggggaggatgtgaaaaactcattgcaagctcattcgcagaagctgccacttgattggcacacattgttttgtcgcgacatgttttctttaacacctgtctgattgcacacattttctatttggagagaagccacacttcccaggttagaatcacagcttcccgcaagtgtgtggtctgaaggaagtctctgaatgtcctggggtcttagtaaggacgtcagaagggggcacagaatgaattggggcaagtagagcaaagcagtcagactgcccggtatgtgagacagcccagaaatgcagtgatttttattcttatttttacccgcctcggatgtgaaagctgtaatataaccgactctggtaaatcaacaccagtgggtcgtaattccttatagcattcatgtgcagcccctacaagtgttaagtggtttagcgtctccttggccctagatggtactaagcggaagtaagagtatgttgtgctgttacgtttaagaagatgacttgggccgatcacggtggctcgcatttgtaatcccagtactttaggaggctgaggcgggaggatagattgaggccaggagtttgagatcaacctgggcaagatagtgagagccccctctctacaaataaaaaattaaaaaattagctggtgtgatggcatgcagttgtggtcctagctacttgggagactgacatgggaggatcccttgagcccaggaggtcaaggctgcgttgagccatgatggcaccactgcactccagactgggtgacaaggtgagaccctgtctccaaaaaaacaaggcgacttagtaaaaaatcggggggaaatatggcaataaatataagaaaacttaaggaggaaatattatgtctataggaaaagcatggttatatatcaaggtaaatactgtgcccagttctcatctaattattgtgagggttgtcaaagaagaaaattgattttataacctctagaattttttcaaagaagggagggaggagggaaagaggagagagagaagaacctgaaaggaaacgggaaatgaaaagaaaaggaagcaaagggaaaagaaatctctcaaaacatcaggtgtgcctttgtttagttgagtatagactgtctgtggtggcttggggtcgtggcgttttaattgcacaatgcaccaatatgatgctgcgcgtgcagtgtaaacagctaactgaaagcagagtaccaaatgaatacacacaagcctcggaagccgcctcaaccggggcagctgctgcccttcaccgagccctggaacttcttttgttacctgagcccttaacactcgtctccaggcaaccggcgccccctccccaccgtctagagtgggaggcgccggcccccggcagggctgcggctctccggtttcatcccaccggtccagattgctgaggagttatgtttaaataacttctctattccgtaatcagtacgctcctcccgacccattaatacagcgaagctgcagtctcatatttggggcctcgaaatcacttctgattgcagggtgggaaaacaaaccaccaccaaagttacaggttatacacgatacccagacagaggcccacaaacagatgtgtatacctatatgtgcacacaaacatgcacacagtacacacgcacgcacatgcatgtgtgcatgcaaacacgcatgtgcgtatatacacagaaacacacaaatgcagacacaaacatgtaaacgccatgcatgcaattgcgtacacacgtgcatatgtaggcagtatcatgtctgtacacacatgcacacctatgtgtgcatatgggtatgtgtgcatacacgtatgcatacagacacacatgcccatatacacacatgcacatgcatatacacccacacatattaatatggtgagctctgtttttcaactgagagactgaataaagtagggacattttaaggcctttcctcaaagaggttcattgtttaaaattgtaggccagggcaacaacattctaaagactcgaggctttgaactcacacctccagtattccagtctctgctgtgtgctacatcgggcccttccttctcagagcacaggaactgtcaaccttggggttctgggtggaaccctatgggttctctctcttatcacaatgatggcttgccctggggccgacctagccacctccaactcctaccaagcaccacgaagctttccataacaggagaccaagtcaaagaaaggtaatggccaccgcctttctcgtattgatcttccgctaacaggcagatcataactgagcacgtcaacccaaacctaatgtattccggggcttactccttggcaaagtggaccagccctgttctccctgaaccaaggcaagaaaactatgtagaaagcagaacatgagaaatcaatctgataaaatgagaccagctcagagaacagtaaacagtgacctctctccctcagtcacctgtctgctctgcaaattaggaactaggtcttcctagcaggtaggcaggtgccaggtggggcccaggtgtgggcggcagtgggaaggggagaggagaacccaccctatacaccgcattcccgccggcagaccaaacagccggcggcactttggtcgctggatgcggggagcaaagaacaattcattaaaggctttcaggatgaaaatcctcacaacaaattgcctttctcctctccctctgagtcttcactcttatgtaaatgtattcaaaaaaccaccactgtgctttcagtgaaatgacaccacaaagctaccagaggtctccgggctgtctgggtgcttggcaaatgtttctaacatccctattaaaacacagcccggatctgcagcatccaaacggagggagattagccgcgaggcagggcgccttcggacggagctaagctggggcttccgaagcgtctctcctcctgatctctatcaggcaattttacgtaatcagaaaaaatcagcttgcaaatgaaacctaaacttcagagtcaaaagttgaaaatggaaagtttttttgtttgttaatggatatggttttaatccaaatgaacaacgtagttatatccatcaagtcctgattctgtgaagtttccagtcaattttaatgccagcttttgttccacatcttcaaaagccgataagatgaacaggagggatgttcattagagggtcaagttaaattgccatactgccatcagtagaaagaaaaaaaggaggtcagcatgtgcaagcactgcagtttccaaatcgtttctataccttttcatgtcagggatgacaggaaagattgtatttcacttaagccctgtcttcccccaaaacaatttcttatataaccatatatataaccataatcagttaaatacaacaatgaaatactttgtggtaattgtccaaggtagaaattcagagtaatattggagtattaacccatttttgttttattcatgtcaagttcatataccagtttacttgtgattggattcctcaagtatcacttcaatatcatcagactcagaagggacagtccctatttgccgtgccgggtatgctgtttgatctgtcccttataagcacatttatgcttgaagcctaatgccatttaactgtgtatcataatcacgacaaaaagagaacggaaaggaggaagcaccagtcaattatctcatcgaacccccgaaagaactatctaccccccacctcacaaaggagcaaacagattcatgatgatgagtgatctgccccaggcccccctacaccgggctggacacaggctccagacccagctgcatcatcactcacccgcttcacccacacagacgcacctgcagatccttcactgcctgcagatgaaaacacaccatttctcacctaatccatgcgcagctccattttggctcttgggcagggatctaatatcttcgcaagcataaaagaaagaaatctcaccctcacaagtattaatacacaacaggatgaaagagtctcgatactcaattccagcagcctccacggctgcccaaaaaacagcagcatattgcacccacacagggtctcagatgaattcagcaaggaaatgtctgcttccctgattttccctagagctgggattctcaatgctttaaagtcaattccatttttatatcgattagatttttaaatagtattataccttattttaaattctcacagggccaggcacagtggctcacacctgcaattccagtgctttgggaggccaaggtgggaggatcacttgagacctggagtgaaagatcaccctgggcaacatagtgatccctcatctctacaaaacattaaaaaataaaaattagccagatgttgtggtgcactcctgtagtcccagctacaggggagtctgagcagggaggattgtttgagcccaggagttcaagaccagcctgggcaacatggagaaatcccatctctacaaaaaattagctgggcatggtggcgtgagcctgtggtcccggctactcagggagctgagatggggggatcacctgagcccaggaggtggaggctgcagtgagctgagatcacccactgcactccagcctggatgacagagcaagatcctgtctcaaaaaaaaaaaagaaaagaaaagaaaaaagaaaaagaaagaaaagaaaagaaaaaagaaaaatgaggaatcgatggaacaaatgacaacatgtccccccattagacacaaagtaaaatcttcaataaacgttgctaagaaacctttcacttcatgtggcggatattcagcaccccagattccatgctcttttctggtcttataaaagagaaggataattctgtttcccattatacaatcctctattaaaatatgatcttcccagaatctctcaaagctgcagatagctatacaatatagttcgagctgataagacataagtagaggtctttcagacatttctgggaaagaatttgctttcctgatagagacctctcgcttcccttctttcctctttctttccttgcttcctttcttccttccttccttccctcctccctccctcccttccttccttctttcatttcttccttcctacctcctttcttctttagaacacacactttggggaagcttgcagaaacaaagtactaagcatgatgattaaggatacaagccggggacaagagtgggaaggagacagagcgtgggatgctggtgagaacattgggtcacagcaccagccctgcctggactgtgtttatctgggtcattttcattatgagaagaagaaattacagcgacccttgaacaacacaggtctgaattgcactagtccacttatacgtaatttttcttcagcctctgtcacccctgagacaagaccagcgcctcctcttcctcctcctcttcagcccactcaacaagaagatgacgagggtgaagaccttcgggatgatccacatccacttcgtgaatacaaagtatattttctcttccttaggattttcttcatgacaatttcttttctctggtttactgtattgtaagactacagtgtataatttgtaaaacatgcaaaatattctttagtttacttttctgtctgtttgtttttgagacagggtctggttctattgcccagtctggagtgcagtggcacaacctcagctcactgcaacctctgcctcccaggctcaagtgatcctcccacctcagcctcctgagtagctgaggctacaggcactcaccaccaggcctggcgaatttttgtattttttgtagagatgtgggtttcaccatgttgcccaggctagtctcgaactcctaagctcaagtaatccacccgcctcggcctcccaaaagtgctgggattacaggcgtgagccactacgcccagacctcattaatcgactgttattggtaaggcttctggtcaacagtagactattagtagttaagtttggggggaataaaaagttatccgtggattttcagttgtaaggggctcaggcccctaacccctgagttgttcaagggtcaactgtaattcctgcttggtcaaggctataagcctaaccctagcatgattgatatgattagcccagtattgcccagacttatttggacacataagctctttttcctagtaggctctgttaacaacaactcacaaaactagttctgctgatcatattttttgaaaaactgaccatatttatttaaataaagggaggggagagttcttctactttgacattttaatagcccatgtgctgctctttggaggttggcggggtgagttttaatgaaagtaaccatagtggaaaataactcaaagaataaaactcagaaatcctggaagcattatgtcaaaagtgtattagtcacctttatctccagaacacaaacattttaaatattatgttctactgcaaaatttataacctagtttttattactgatttgcattacttggacaggagttatcatttaaaccatcttccatgaacaaaatatataccacagctgcttgctactctgccttcttttacctacagtaattcaaaataagcaccagctctttcttgttcctattttacacattccgacatgcaggtctggaaggcagtgtggagttgccaagatgggaactggagtcaggaccgaagggctgtcctggagccgggccttctgagagggcagtcaccgggcacagctagctgttccgcaccagaaacgtggctagtatgtatggagatgccccataagtgtaaaatacacacaagatttccaagatcccatatgaaaaaagaacataaacacgccattaataattgatatattaattataggttgaaatcataatatttttgatgtattaggttggccacatatattattaaaattaatttcatctgcttatttttcataatggggctgctagaaaatttagaattacaaatatggcttggatctgtgactggcattacatttctattagacagtgagttctagacacttttgttcttgttgttgttgttgttgttgttgttgttgttgttgttgagacagggtctcactccatcacccaggctggagtgcagtggcacaatctcggctcactgcaacctccgcctcccaggttcaagtgatcctcttatctcagcctcctgagtagctgagactacaggcatgtgccatcatgctcgactaatttttgtaatttttgtagagatggggttttgccatgttgcccaggctggtctcaaactcctggacttaagcgatccacctacctcagcctcccaaagtgggaggccaccgtgcccagccttagacacttttttctcattattatgttgtgacttgttaggagaatctttgggcctcagtttcccctatctatagaatgtggtgcttggaacatgtttttcgcagctttagacttgtggattgtcaaagctgtgcatttcctctttcctttccttgtctcctaagaaaaacagtcctttaacatcttcctgggaagaacatcgagcttacagtcagaaagtctggtgtgagtcctgtttctgccactccacggccaagtaagtgactttggaaaggtcactgattctttagtatcagttttgctgagagaaacccatatttaaaatgttttaaataaagtcctccccaaatgttaggctggctctgagtagacatgtggttgtcttgaaagagggtatttattcacagagacagaaaacaatatgtaggaaaagtcttttgaataatggaggaacgtcttcccaggagcttgcagcctgaagcctaaaatgcagaatcacaaaaaatgcctcccacaactgccttatgagttactttcaatcatccttctgaagactgcagcaattagcacttgggttcccaaggggaagtgaatctcagtaagacaacaattatgtagcagatactcttccaagtactcagaatacagcaagaaaacaaaaattctgtcatggcttctcctgcttatggtgattatgttcctgagattccagaagttatagcattgcaaagacctgtgcaggagcaattaggaacaaaagtagctagcacaaaagacatgcaggtggaaaaggttctataaacatgacagaaagtgcctctctattaaagttagaactttacacacaaattgtctcagaattttgcagtgagttgatctcttgtgacataagtaggtgacaaatcagagataggtaagtatagaatgactaagaagatgaagtagaacagaagacaacagatatccctggtgatgctagaagccaaattagaggagacgttgaggatccaaagcagaagggcagaggcagggctcggggcaatttcctgaagttcagctttagagtgggtttctcataccatgggcagcaatttgcccaatgatcaagtttgcaggtttaggaaccaacgaatcacttcagaagccactctaatatgtataagtggatatttttcctaaaactttgtatatgttgatgtcttaactgttattaaaccatatgcaacgtattcactgtcgtaatccatgtcactcaaggactcactgtcttggatttccccagaatcaagttaaaataatgtattaagatattttacaggccaggcatagtggctcatgcctgtaatcccaacactttgagaggctaaggtaggagaatagcttgagcgcagcagttcaagaccagcctgggtaacacagggagacctcatcctacaaatctaaaaaaattacccagcctggtggcccacacccgtggtcccagctactcaggaggctgaggtgggaggatcacttgagcccaggaggtggaagttgcagcgagctatgatcatgccactccactccagcctgggcaacagagcaagacccagtctccaaaaaaaaaaaaaaagatattttacagaatactagctcatggtggccctggaccttcaggatcagaatttgctctgcaacaagataccctagtgatccatgagcacatgtaaacaccactgatttaagctctttctcctctttttgataaagtccttattccaatgacttcaaatatcatctgtgtagatgactccccttataagactgtgttcatactattattatatcaagctgctgcaacttcctacttatttttttctttttttttttttttttttttttttagacaaagtctcactctgtcgcccaggctggagtgcagtggtgtgatcatggctcactgtaacctcgacctgcagggtttaagcaatcttcttgcctcagcctctcgagtagctgagactacaggcatgtgccaccatgctcagttaatttttttttctttttttttttttttgtagagatgaggtctcattatgttgcccaggctgttctcaaactgctggctcaaggagtcctcccaccttagagtcccaaagttctgggattacaggcatgagtcaccatgcttggagtcctccttattctgattttggtagctgtgttttttttttttttagacagtctcgctctgttgcccaggctggagtgctggagtgcagtggtacaatctcagctcactgcaacctctgcctcctgggttcaagcgattctcatgcctcggcctcctgagtagctgggattacaggcacccactaccacacccagctaatttttttgtatttttagtggagacaggggttttgccatgttggccaggctggtctcaactcttggcttcaagtgatccacttgcctcagcctcccaaactgctgggattacaggcatgagccactgagcccggcctggtagctgtgcttttaatgtagagtttacaagtggtctctgtttcctagagtcactgacaatgtggcttggaggttgccattctccttggagctctgtatggttcctgggagaaggcaatgcagaattaagctgccaccatgcttctatcagaaccagaaattgtattctcggacacttttgaaatgatttattctttattccctctgtttttcagttttcttttttgttttctcttcctcgaactgctatgttcagctactggacctgctggagtggtcctgtaattttctcttttgtcatccattgcttcttggtgtttttgttctatttcctaggagatctccccaactccctctcaggaagtgagccctgtctgtatacacccagatccagctggcatgtacatccatgtctgtcagcctgtcttccaactgccgacaccgacaactcttggcttggggactttctgtggtaaccagattccactccactcttgagggcagcaagctgtaaaggggggcgggggggaattattctaacgtggagcagttctcagctaatgactgacgggcttcactcactcagcacggctccctggagatctgtcaagttactgcacacatcaatggtttgttcctttcattgctgagtagtgctccacagcacagacgtaccacagtttctttaccacccatctgtcaaggaacactaggagctgtttgtagtttgggaccattatgaataaagctgctatgaatattcgatgcaggtcttaggaactaacgaaatttatgtgaacctaatttctctgcaacaaatacccaagggggcaattgctcagtggtacagtatttgcatgttttacggtggcaggattttgaagaatcatcaatgccaagctacaggagtttggatttcaaagaatggcatgaaaagtgttcacaaacttttgggtagacggcatgtgatcagagtagtcccacattaaaagtaagaatcccgtgcaatatggagaccaaattggacaggaagagtctgggccacggtaatcaaaggtaggacaaggtacgtgaactcagacggggtcactgagggaggacaggggaaaaggacccaggagcaaggtactttgagatcttagggagttaattccacagttggaaaaaagatatccttgtaaatatgcctctctggacttcttcagccctcaggaagacgttcgaggagaaatataaacaaagaaaagcaaaatagaaactagttgtggtcaaatgtatttttaattaatgtgtccgtctaacattaaaaatgattcctataaacaaaaactatggcttcagtaatagctgagagaagattttccccctcattttttccagtctgcagcctccgaagcctccaagtactgcttttaataaaataaaacacaatgtgcttctgtgggtaaattatgattttcccctaatatattctaattcaaactattttcagagcctgatctgaaaattgctcccatatctataaaaagcacatgtattttgagaaataaaagatgagaaacaagacgaaaaagatactaaaaaaaaaaaaaaaaagttgcagcctgtctggttacagcttgagccaagaatctgagaaagaaaatgtcctgagaaaatcgttctctccaacagtttcaaaaaagaaagagcccagacaaaaataagcctctggcaaatggagcctgtgcaagaatccatccaaaaaatctaatttaaaaaatatagtatcttacttgcacatcatattttggatacctgaaagataaattattattaaattttttaaagaatgatcccaactttatcacagccccctatctctttgtagtttcttataatagggttaaagttggctggtttatttatttgtttttttttttttaagttgtttttcacaaaaccttagaagtagaaagcaaacctaccattcaatgtttcaaagctggctggtcaggaaacccagtttcagcaaagaagaaaagccatgcaaaacaaacaaagaaagagaaggcctgcaaagatgtatttggacttggttttcttcagccaaagggatagcacagttgttgcaatttcgttagatgaaacaactatgaacaactccagtcagagactacgggttgctgaatccaaacactgctttccctagattcatatgtttctctaatagtctctttctccagcctgttcctgtgttctgctatacaaggaacacacagttcttgctccaagagtgtatttaatgagacatcaggcaatgtttcagtcgtagagccacccccagaactctgaagctgattctcataaggatgtatgaggtgcatctcttaacgctctgaagtgggcaggtgagttttctctgccatatttacaaatatctgcactcgtcttcagaggctgccaagggtagagagattttataaaatctgacacaccagaattttttaactagcttgcaaatcctgaatatcccagattttcttacatgtgaatgtgttcactatcaaaccatagcacatacaaatgtgctctgtatccaatacatttaggtaaatgtgacctgtttacttgaattaccattatagttagttgttaggtgctcgagtatacatgacttgtagccaagcgaaggggaggagcgtaattcaaagcctaagtatgattgcatctacaaagtttttaaatcttttatccattacacaaggacatggctttaaaaccactcttttgttcaaaagctgatcacattcatgattcctgaatgggtggtttctgaactcacttttttaaaaccttaattcttttgtgccatatgcttatgtatgtcctgcccactagattgtggggaaatcagtatatttactaagcacgttctcaaatgtaggtaacagcatatgactgacgcctacacatgagggtagccagcctccaatgtggccctcaatgatcttcaccaactggaattcatgcccttgagttgtccactcccacatcaaccaggactggtctcacacatccagtagaaacaacagtgtttgatttccaaggctaagtcctaaaaggcatcaacactttcaccttggcttttggatcacccactctgaaaacgctggctgccatgttgtgaggacactcgagcagcaggaggagaggtccacataaatagaacagcctgccagtcacagagggagccactgtggaggcacttggaagcagatcctccagtcccagtcaagccttcagatgaacacagcctgggctgatggctgactgcaacctcctgagacactcagaaccagaaccaccccactaagtcacttccaaatacttgaccctcacaatccctgagagataagaaatgactgcctttgttttctcttaagccactatattttgggatgatttgttacacagccattgtaactggaatgcacacatacatgtatacaccaaacacagattacccagaaaaagactcaactctactatgaacaaattttcgccaaggtctcagcccttccagcagattattcagtggatcaaattaaataattttttattcatggtctttaaaggatccaaacattgactgtgaatattttgcatattaattatatttttcatcttagagccaatgtatcttctcctataacattcctttttctagttatattctgataaagggcgtggagatagtctgaatgcctctccaaatttttccataactgtctagatatgactgtccacaacccatgtgagttatgaaattacgtgatatatcatctaattgacaaaaagtagaaatcaaattgagacggtatagaacatgatttagtttttttttacaaaagcaagcttggccaggcacagtggctcatgcctttaatcccagctctttgggaggccaaggcaggagaatcacttaaggccaggagttcgagacgagcctggccaatatggcaaaaccctgtctctactaaaaatacaaaaattagctgggcatggtggtgcacgcctgtaatcccagatactcaggaagctatggcagaagaattggtgaacccaggaggtggagggttgcagttagctcagattgcgccactgcactccagcctgggcgaaagagcgagactctgtcaaagaagaaaagagaagagaagagaagagaagagaaaaagaaaagaaaagaaaagaaagaaggaaggaaggaaggaaggaaggaaggaaggaaggaaggaaggaaggaaggaaagaaagaaagaaagaaagaaagaaagaaagaaagaaagaaagaaagaaagaaagaaagaaaaggaaggaaaggaaggaaaggaaagaaaggaaagaaaacttaatagagtttggggaaaatattgagataaaattgtaagtattctatcaagtacattgaaataaaattaacctcaagggttttttttgtttatttgttttactgtatgcatgtaatggactgaatattagctgtattagatgctacattgtgaacaagactatattggatatgccaagcccttcatttaatttttttttttttttgagacagggtctcactctgtgcccaggctagagtgcagtgctgcgatcacagttcattgcagcctcaacttctccaaagccctttgtttttaagaaacaatttatcttgatacaatgagattcctataaaacaggcttgctgcatttgctatgtgttttctatcttgctacacctataccaagatgaaattcttaccgtgttagccaaagtctctttcagtcaaatacatcccaaattatattcataaaatcaaatgtatgagatttgctcacagataagtggaataactcagttcgtgtgaaattatatgagcaaacccaatatccagaagacccctaaagagaatccagcctgtcatgcataataaaatttaaaacaaaaattaagaaggttctctcaccatagcagggaatttctcaagcacagaaaactgccttctatattctgagtaattacccaaataaaatgtctatttgtccctccttcagccagatgtttctccaaccgcagtgccacctcctctttgaaaagtctaccctctaatcccacaagaaaacatcttgtaaaaataaggaaaaaaatttagtaagtgactatcctgctttcttgtgtatctggatttaatttttcattatttacatcaagggaaaagaaacatggcacaaagtggcttttttgcgtacctttaaaaaattttttctgttgagcatttcctacgaccagacaatggttctaagcattcagttatccaactaggattgctcatgtaatcctatgttgggattagtactgttatcctctttttcacaataaggaaactgaggctcagagacagtaggaaatttcagccagttcatccagctagtatgaggcaggataagagtttgaacctgggaagtctgatcccaaagcctacacccttaaccattattctatgcccctggtcatttgaattcataaaatcagcctccaagggcatctgtacttagtggctttaaaacaagctattttatcatctatcccacggtgcagaacagaatggaattcccaagaaatctgggagtcccctgtacaggtgttgcataccttctacaagtccctcacaccttccagaagcttctcaaagatgccggtgatgctgcttcgtattatcaatgtacaaagcaatgcactgaaaggggttttcctgacttataagactataattgaaaaaccaagtgcttctaattcaactacctcaagaaattccaaaaacagagtacgttttaaggaaatgtttatagtcaaggactagggttggtggtttggtgtcaagtcaagcagcatcaagaaagatttaattgttgttctagtcccatgttgtagcattatgtagtatgctgcatgtgtgtttatttttttaattaatttttttttttttgagacagggtctcaccctgttgcccaggttggagtgaagttccagctcactacagcctcaacctcccaagctcaaggaatctcccacctcagccttccaagtagctgagactgtatgcatgtaatggacaggcacatggcaccacacccagctaatttttgtattttctgtagagacggggtttcaccatattacccaggcttgtctctagctcctgagctcaagccatccgcccacctcagcctcccaatgtgctaggattataggcatgagccaccacgccgggcctgtatatgttcttggccagttttaagatgagaaacacaacagtggccaacacaaaatcaaaatatacttgtaaaacatagttaatctagggaaattgataactaatatgtaattaaggagaacatagcaattggtacattggaaagcaacttgactttgctaatggcaagctgtttgctagaaacacagacacagacacacacacacacacacacacacaaggttataaaagggtaaataataagtgtggttccttttgtaacagggactcagtaattcactaccaggaagttttctaaaaactcaccctacagagaaaagaatctgaatgaatgtaaagtgttaaggcagttgatggctgaggaattgtcaaattatcaaaatgccacgtgatgatggtatctgagtgagactgataccgctaaccataaaataggtgagccctgcaacagcttgacaaggttaagcaccttaggaaagcaatgataataaagatgaaatactaattaaaatatcttcttgagtttatgcactctccttggaaaaaataccaagaaatcatcactggatactatctaactataatacagcactatgatagattaccgacttgtgtttttttctttgaggtattcagttcaatgaagaataatttaatttagaatcattaaaaagtgttagagctgaaagaatctttaaagagcatgaatgcaattaccttgtttttaaacggtgaacctaaagcttggacaagccgactgaattaccccagatcctgtctttatttcatttgtgtttccgttccctcattcagcacacaagacataaaccagtaaccacgccaagccagggtgatgttgagcctgcacaacctgtgccaccgccaggcagtgcaaagctaatgttagatccagacctcctgatttctggccaaagatgcacagaaaaaagcacaaaggcatctatgtccattgtcggagtcaaaagtctagcaataaagacagttttttttttcgttgttgaaacggagtctcgctctgtcgcccaggctggagtacagtggcgcgatctctgcccactgcaagctctgcctcctgggttcacgccattctcctgcctcagcctcctgagtagctgggaccacaagcacccgccaccactcccagctaattgtttttttgtatttttagtagagacgggttttcaccctgttagccaggatggtctccatctcctgacctcgtgatccgcccacctcggcctcccaaagtgctgggattacaggcgtgagccacgctgcagccagccaggagacactattaataccgaatggtgatgtctatggcaaaagcaccaacaccatagccatctccgcagcagcctaaatgattctgacagccatgggccagtccactgattccagaaacacttaatagtgagttccggaaaagaaaaagcaatgccccattttctttggatgtacagcatgcggcaaagcagtccactgtggagaccagagtacgtgatcaccaaagatggcttgactgagcctagcaagttgcgttagagggcttctgctgccattgtatgtcgcttcttgggcacttttctcatcttttttgacactgatctttaggaagaaagaggggaaattaggctaattgtggggaaaaaggaaaggtaaaaatggccaatggtcagagagacttgcaactgcccgaaaacaggcaagtaagcactcgtgttaaaatagagccacgatggtagagttagggatatcagcagataaaagccaaaagctaacagtaaaggagaaacacacatgaatgccttcatcacagaagctgctgatctctgcacatcaggagcttacaaactgaaagagttagagcagcatagacacacagaaagtggatgccaaaggaaacaactggcacactcatcccagctgggattcagggcctcactactcatcactggcacccgcattaaagacacaaaggaagaaactagaagaaatgaagctacaagatagccttcaccacaatcactaacacatggaatatgcgtagtgttaatgtgtagtgttaaagcattagttgctcttcattagcacaaaacattccttcatttcttcatttgtcaccagctgttttttttttttttcatctcttttctgtgtatctgtgttggtttaactcttttcattggtaagcccctaatgagtagagatcaacaacatctattaattgaaactaatgccgaaaagtacaaaaaaatgtggatagaaaaaaataaacatcttagggatgaaaagagccattgaaatttcaaacatgatagacagaatctactttaagctggctgaacacagccaagaaaagaaatcatgattagaaggctgaatcaaaaaatcttcccaaaacagacagacaaagagttacaaattggtttaatcaaagaaatattgaggaactccaatccatatcaacctaaagttccaatagaagagaatgaaaatagtctgggcgcagtggctcactcctgtaatcccagcactttgggaggctgggacagatggatcacttgaggtcaagagttcaagaccatcctggccaacatggtgaaatcccatctctaaaaaaaaaaagaaaagaaaaaaaaattagctggaccttgtggtgtgtgcctctgatcccagctacgctggaggctgaggcaggagaatcgcttgaatgggggaggcagaggttgcaatgagccaagatcgtgccactgcactccagcctgggcaacagagcgagactccgccaaaaaaaaaaaaagaagagaatgaaaatgaaaagatggagaaagtcttcaacagcccacaacatcaggcctgaatcaccctggaaactcttcaatgcttaacaaatgtcttgcactgcataaatagggagtttataagtgtggggatccatgtttcttgcctttttttttttttttttttttgagacaggctctcactctgtcaagcaggcaagagtgcagtggtgcaatacagctcactgcagccctgaccttccaggctctcagcctcccaagtagctaggactacagatgcacaccaccatgcccagataacttttgtatttttttgtacagacagggttttgccatgttgcccatgctggtctcaaactcccaggctcaaaagatccatccacctcagcctcccaaagtgctgggattacaggcatgagccaccacgctcggccacgcttttccaaatgactaacctctatataactccttaaaatttacaaatctttcttcacttacggcatttcacttagtcctctcttagcagctttgtgacatgggtatcattgtttataaaatttatttttactttgaattttttatagagacagggtctcactctgttacccaggctggagtgcagtggtgcaatcatagctcactgcagcctcaaactcccggcctcaagggatcctccctcctgagcttcccaaagtgctagcattacaggcgtgagccaccatgcccagccatggtattattaaacttatttgtcacatgagaaaactaaaactcacagggaatgtagacacttgctcatcatcccacagctagaggaaaatgagccatatttaaatggtttttaaatatgtccagtatctttgatacttctcctttcaaaacatggagcccaattgttcttcttcgagtgtgggctgtatttagtgacttgcttccaacaaatagaataagggtgaaataaaggtatgaaacttccaagactaagtcatagaaggcactgtgtcttccatctggctctctctttgatcactcactctgagggaagctagccgccacgttgtgaggacactcaagcagcccattggacaggtccacttgctgcgaatgagaatgacaatcaaaagccaaagaagaattgatgcctcctaccaaaagccatgtgggtgagccatcttggaagcagatcctccagccccaattaaggctttagctgacttcagccagggctgaagtcttaactgcaatctcatgagagatcctgagtcataaccacccaagtaagttgctcccaaattcctatccctagaaactatgtgataataaacagttgttgtaaactgcaagggagtgacttgtcacatggcaataggtaataaatatgccaggaattaaatccaaaggtctcaacccaaaagcctgtgctttttcatttaacaacactaccttttccatgacgtcttgtgtaaaatcaaaatattttgaccatctcaacttacatttccctaactgtcagttcaatttttgccaattatgtcaccttattctgtgcctaattataggacttcttgcatttttgaaacactaatctccccttctgaataataacggtcatgagaacaggggatagagcagttttggtcatcatagcatccccaggatcaaatttactgctcagtaagtaataagcactgggtgtatatttttggatgaatgaatgaatgatggccaaaatacatatgacacaactagtctaccacagggctttgttctcatttttatgctgacacaaaagggaataaattctatatctaagaagaaactagggaatatcttggagttgtgactttgattgatctgagcttcccagaagacatttgttttattcagaaaatactttgaagggcaagaagtatgactgttttttcagtaacatgcaaaaatccctagggcatgcaaaaataagaataatttcctaaactaaaatgtcttgttcgatcctccaagtgttcttccgctccctgttccaggcccactggagagtttcggcagcaggccctcagacaggagtggtctggcctgctgatgacctcatctcaccccagcccacctccagctgcagagaggagttgtgagcactgggttaaggcagcatttttctgggcaagttacttatgctcacatgagccgtaaatcaacatgcagtcctaagttgtgatggcttttcacttggtgggaaatgcctaaacacccagatttttatttcacagccaggaaaaaaataatgtgtgagagaaacaaaatgcagaagtgcctatcagacatgactgaaataagaatcccaaggaacacgaaatgttactacagtgatgcagctttgatcacggaccaaacatttttctagtaaccactaaaacaggacacatcacatgtacatttttcatacaatccaccctccttcggcgtttcaccatctcatcctctgctgcccactacatttctgtgatgatggaaatgttctctgctgcctaacagagtagccactagccacttgtggtcactgagcacttaaaatgtggctagcttaactgagaactgaatcttattagtaatttaattattaatcaattattaattactaaattgatttcagttcaattaaatttaaatagccacatgtggctagaagatatattgtattggactgaaccatttcatacagcgttctgggcacattcaaaacggttggagtaatttagatcgaagacaggctgggaattacgactccttttgccaaagatggatagaaaggtactcaaaaccccaaaatctcaagctgtttttcaaaacaatgagggaaccctatgggtctactattttctggagtttcttaaaatcaacacctaatctgaaaagagagataagaaagagaggagacagtacacctaaggtcttcaacccaagtcccatcaaggaaagaaggttctgtgtgatctattactggggaaccaacatacacctttggggtgaaatggagctgcaatgggaagcagaggctgcttagaatacaaatcagattccatggccgggtgcagtggctcacacctgtaatatcaactctttgggaggcttaagcagggcaatcgcttgggcccaggagtttgagaccacctaagcaacataggaagatcccatctctacaaacaaattaaaaaatgagctgggcatagtgaagtgtacctatggtcccaatactttgggaggctgaagcagcaggatcacttgagctcaagaggtcgaggctgcagtgagctatgatcatgccactgcactccagcctgggtgatggatgggagggaagaagggaaggagggagagaaggaaggaagggaaggagggaaggaaggaagggaaggaaaagaagggaaggaaggaaaggaagggaaggggagggagagagggagggagggaaggaaatgaaggaaagagggaaggagggaaggaaggaagggagggagggagggagggagggagggaaggagggaaggagggaaggagggaagggagggaaaggagggaaggaaggaagaaaataggttccgaagcccttggagtacccaagtaaattacaaagctgtaaactgcttaggggtgagttcaaactctgcaagctgcaaggaagcacccacccggccctgcccacctcctgagacccagccaccttatttcttttggctccccaaggtggccctaacatgggctcggggacgctcggtctctaaacccaggctggcactttctttcctgctctctgtgtggcttcctgactatgcccatcaagctctctgtggagcaactggaacctcgccccctgctggtgggagtgtgaactgctgccactacttaaggactgtctactattccggggcatacaccccacagaaatttgcatatatgatcaccctaagacatgcatttgcatacccatagcaacagactcttcaaagtgtcctaaaacgaaacatcccaaatcccaacaacaatagaatggattaatgtggtatatgtatacagggaaatactacgagcaatgaaacaaatgacctgcacctccacgtaagagtgaaatatcccacaagcgtgatgatgaggtaaaccagctaaatagagcatggttccgtgtatagaaagtacacaaatgggtaccatgcattcacactgctcagagaggtggtgggtggtgatgggaagtggatgggggcagaaggttccagggtgctgggagtgttattttcttgatatggctgctggttaggtgtgtgtgctctgttgtcaaaagttagcaatgggcagggtccagtggctcacgcctgtaatcccagcactttaggaggttgaagtgggaggattgtttgaggccaggagttcaagaccaccctgggcaacacagtaaaaccccatctttacaaaaaatgaaaaaaaaaataataataattagccaggtctggtgatgcacacccgtagtcccagctacttgaaaagctgaggtgaaaggattgcttgagaccaggaggtcaacactgcagtgagccatgagcacgtcactgcactctagcctgggtgacagagcaagactctgtctcaaaaaaaaaaaagttagcaatgcatacccttacaataaacacatactttacttcgtagtttttcttttaagaatgttctatccatcctcagagtacagctgaaaactcaccacttccttgaaccatgaaactgtcctataaccatctttcattttctctctattaaaaaaacataaattatttcatgcacatttgctctattgtatctgtcagaatttttttttttttttttttttttttttttttttttttaggacagagtctcactctgttgcccagactggagtgcagtggcatgatctcagctcactgcaacctccacttcccaggttcaaaagattctcatgcctcagcctcccaagtagctgggacttcaggcatgagccaccacgcttggctaatttttgttttttttgttttttggtttttttgtttttttaagtagagatggggtttcaccatgatgtccaggctggtctcgaactcctcaccttaggtgatccacccaccttggactcccaaagtgccgggattacaggtgttatctatcagaatttaaacactgcgttttttgttttttgtttttttttgagacggagtctcactctgtcgcccaggctggagtgcagtggagtgatctcggctcactgcaagctccgcctcctgggttcacgccattctcctgcctcagcctcccgagtggctggaactacaggcgcccgccaccacgcccggctaattttttttgtatttttagtagagacggggtttcaccatgttagccaagatggtctcgatctcctgacctcgtgatccacccgcctcggcctcccaaagtgctgggattacaggcatgagccaccgcgcccggccaacactgcgatttttaaacctctcttggtgttgaaccaagtattgctcacgaaacacatacttcataaactcttttaaaccaaccactgcttttctattactaaaacttgcttaaatgacaaaagacaggtattatctcacagtctctgtgaattttcaaacagctgagttcagttaagcacacagttgcctgcacatataaaaaatggaaaatattgcaacaaaaaagactctggaattttccatccacacagctgttgctgcgtggcatctgtggtgtaaccttcacttgatggaactaactcccacaatcccacgcaagagaaatgatcccattccattacagtcctgtcactatacagggcaaaaacatcagaaatgattaagaaaagaagaaaagacaccgcactcaaaaaaatgtgatgaaaacttttacagtgcactagatcaagaatttgaaaactcgtagtaattcccatttttgtgggtttccaaatgacaggtgactacttagtaggcccattctttttttttttttttttttttttcgaaacggagtttcactcttgttgcccaggctggagtgcaatggcacgatctcggctcaccgcaacctccgcctcccggtttcaagccattctcctgcctcagcctcccgagtagctgggattacaggtatgcaccaccatgcccggctaattttgtatttttagtagatacggggtttctccacgttggtcaggctggtctcaaactcctgacctcaggtgatccacccgcctcagcctcccaaagtgctgggattacaggcataagccaccgtgcccggccgcccattcttttgctcataaactatgagaacagaggacaagagatatatgaattcatcaactggtcctaaattatggtagtcacttataggagccctcaccgagacccccacacatacataatagggaggattttcctcgacaaacgtggccaattcagattcattcagtagacaactctttctttcacgccacattcctcacttctcctttcctgctagccaaacgctccccacaaagaggctgcttcttgaaacgttcttatattttgcttggtttcaacagccctgcagaaagcggcagggaagtaatctccaatctgcagaaatgacagaagccaggaggctgtgggcctccttaaaactttcacctccgctctgaatacgcaggctgccaatctccccatccctagagtttaatgggggaagttcaatgtcattgcatgtagtgtcatctgacatatttataaacacccagagggaaagcagaacagaacatccgcaagtgtgttccttaaaaagactcttctcaaacttccacgaagccacacaagccgcatatgactgtaaaagaatccacgaaatcctggaaccagcctgcccggataaagctgtttggcgtgccatgtgttaggctgacccgaaacttttcacttggtaggagctacattattgcttggttaatatacacttggattaaagaaattttcagaatagtcaaatttatcaccccagttctaaggagtgaactaaaaacaaaaacttaaaacacagatacttcctccttttttctccctcgatccttccacctctctctctctctactctctctctctctctctctctctctgtcactcactcaatctcagacattcattaccctgaagccacctcggtcctgcctcagggaaaaggactcatgaggccaagggagagcaggggatgcgcctacgtgaagccctccggcttccaggccatgcctataggccctagcacctcttccctaaatggggacaagggtgagggccccctagggtacactgatggaaagtctgtaccagggtgtgaagacctcccaccacacaggtcagagcctgagggggtagcagaaagcccaggcgtgggccagggctgtgcgctccgcatcactttgtatctgcattgccagggaggccaaggaagctgcaaccaaccctggctgtctgaagcatggcctggaaggtagcaggatagaagagattctcttcagcaggtggttagcttgatttacagctcatggtgtacacccaaggcaagtgggggtctgtttgtgccccagccctggaccctcagcaacgttgggaagggcctgcaggccacaccccaggtagcaggagagacaaaagacaacagaaaatacaaaacgaaccaggcagagaacagctcagagaggcatgcatgggaaagcccaagacacagctgcacagacaaagaagcttgacctcggcgcatggagagtgagggcccagcagtgccaaagaagctggccccacccacccaaggatttcacaaggaacattccaaatgccccgcttgtcacccaatgcccagctgcacacgctaaattattgcacatctctgagcttcctattataatattataaccaccgcctgctgttatcacactcttttgagccaaattgcacccaacagagcatttcattgttctggtcctgtctcaaggctgttcttcaggtgacggaattaaaacaaagaggtgagtgtgtgtgtgcatgcatgcagtatacatcacatgcacacacagataaagatggaccaccaggccaggcgcggtgcctcacacctgtaatcccagcactttgggaggccgaggcgggtggatcacttgagctcaggagtttgagaccagcctgagcaacatggcaaaacctcacctctacaaaaaaaatacaaaaattaaccaggcatggtggcaggcacctgtagtctctctcggtgctctccgaggacacctcgctgccctggacttccccctctgtcaccggccctttcttctaggtcccctggggtccttctctcttgcctgggatgctggtgtttcctgaggagctcccctgctccccttcttgtgacccattcctcactttccctgggccccttgacctgcacagatgacatcgagtctacagctctaaaccggggcttcctccaagctctggattttgaatgaaccagaaatatctgaaagtcaatatgttgggcattggagtcactatggttcctgcctggcactctattccattccagtactattttcttatacttcccctaggagggagaagggcagaattggtgacttccagggaggatggagggacacagatgatccccaagtttcaagcatgcatgacaaatcagaaaggggcttcgttcagcaagacctgactagtacagattgctgattttgtgggctatacacccacaggaagctgcacttccccagagtttgggtcacaatggggtttcctgccacattgcagatacccaatgagtattcagtgaaagaatagatgagtgacaattgattaattgacttagaaatgacaaggcaggttccgtttgcaaagggctgagtcatattataaaatcctcaactgcagcataactggataaggtgtttctgtaattccctgagtgttatataatgggtagccattagggctcatttagttgcaaataacagaaaccagtacgctaaccaacttctacactcaaggtaatgtactgggccctgtaacagagaggcccagcaggaaggctaaagagaggcaagacttgaaccggggtcagaaaatcatcaggaccaagatcaggttctttgcagttctcagctctgccctgtcagcctgagttttccttccaggtggggtctccctcgtaggcccccgatgagtgcaagccattccggctgctttctgcctctgggccaacagacaggagtcttttctggcagcacccaggaacgaataaggccttcctttctccttgcctttgcggcaggtgtcggtctctggatgcatgaacgggaccagcagggatggaagaggctttggctgggatccagctaattcacatgtcaggtacaaaaatgggagagaatgaattccccagcagggaatcggggttctgtcgagcagagtagtgggaaacctctgcagaaaatgtgaacgccaaacgtacaatctgccgcgtatacgtaatgattgcaaatgtcaaaaacctaaagtcagtgttaacattgagcaaaatgttacttttctaaaatcatttcttatctcaaattgtggctccctcaattttttaaggacaatggaaattttttatgtctccattatggtagtaactccatgactgtttgaattggtcaaaattcatagaacttcagcaaagtctagagaccttatgtaaaggtctagataataaatattttcgagattgagggccaagactgttgcaattactccagcttgcacttgcaacagcaagcaaagcagccatacgcaatacgtaaatgaatagaaatggctatattaccagaaaacttattaaaaaaaaaagtcaataggctgaatgggacccctgaattgcacgcagcctgaggagccctgaacttaaaatatatgaattttactatagttaattaaacctcaataaataaacagaataaaggaagacaaaggaaaaataaatgctgtaggggagaaaactgtaattccttcaacttaacctgaagtgaaatgtcatcaagaaaacaggggctgagtgcagtggttcacgcctgtaatcccataactttgggaggttaaggcaggaagatcacttgaggtcaggaattccaggatccagtgatccatgatcacaccattgcactccagcctgggcaacagagcaagactgtgtctctaaaaaataaatacataaataaataataaaaagacaacagaggtacagtactccccccttatctgctgttttgccttccgagttttcagttacctgaaatcaaccacagcccaaaaatactccatgtaaagttccagaaataaacaatccctaagttgtaaattgcctgccattctgagcaatgtgatgaaatctctcactaccctgctccatcttgcctgggatgtgaatctcccctttgtctagttggtgatccgaccaactgtctcggtgtcacggtgcttattttacctaataatgaccccaaagcacaagaggagtgatgttgtccatttggctatggacagcataagagaagccataatgtgccccctttaagtgaaatggtaaaagttctcagcttcataagaaaaggaaaaaaaatcttatgccagacttgctaagatctacagtaagagcaaaccttccattggtaaaattgtgaagaaggaagaagaaattcatgccagttttgctgtcacatctcaaactgcaaaggttgtggccacagtgtgtgataagtgcttagttaagatgcaaaaggcattaaatttgtgggtggaagacctgaacaaaaatgtgttacagcccaggtgtggtggatcatgcctttaatcccagcactttgggaggccaaggcaggaggatagcccaagcccaggattttgagaccagcctgagtaacatactgagactccccatctgaaatacatatatattaaaaaaaaatttttttttgagatggagtctcactctgtcacccaggctggagtgtagtggtgcgatcttggctgactgcaacctctgcctcccagttcaagcgattctcctgcctcagcctcctaagtagatgggattccaggtgcctgccaccacgcctggctaatttttggtatttttagtagagacagggtttcaccatgttattcaggttggtcttgaactcctgacctcagatgatgtgcccaccttggcctcccaaagtgctgggattacaggcgtgagccaccgcccctggcccatattgtttttaatttaaaaaataataagaaggatgtgttctgactgacagcaatctggtccagtgctatcagcggtttcaggcatccagtgggggtttcagaatgtaccccctgcagataaaggggcactactaaagttttgtttgtgagagggatttcctgacggtcgctgtgcaaaggctgagccagaagatttacgaaagttaaacaaagagtgtttaacttggcttttgaagacattttattgactcacttggtaaactcactaagaagtcgagtacccacctctgttcttgacaaaggcatctgcagcaggctgtgttcacatcaccactccaaaactgagtttcgttaggtttttgtttgattgttttttcctagcgggatgactttaagagtcatcattttgtgcttctggttctttattgtttgctcttttacagcatagcaatcttcattggacagagattgtgaaggagacccagtcatttcttcccttactccaaataatggcacgaacaacgcagctccaaggctatgagtccatccaaattgaatggaaagtcaaacttttgggacccagaaagtgaatactctcaagaaggaaagtggggcctggcacggtggctcacgcctgtaattccagcactctgggaggccaaggcgggtggatcacttgaagtcgggagttccagaccagcctggccaacatggtgaaacctcgtctctacaaaaatacaaaaattagccgagcatgatggcgggtgcctgtaatcccagctacccaggaggctgaggcgggagaatcgcttgaacccgggaggcggagcttgcagtgtgctgagatagggccactgcactccagcctgggcgacagagcgagactccgtctccaaaaaaaaaaaaaaaagaagaagaagaagaaggaaagggcagggggcggggaagggcgaagggaaagcaggagagttcaaaatcagagctcatcaggcagcattcaagcatccaagttgacgtacgcaaagtgataaaggggtgttactgtgcgcgcggaaatgcaggttttatacaagattcacaatcaacctctgtcatctggattttttaagctgaagaacagataaagaatcaaggtgttcacctcatctttaagtagaagaaatagacttttaaatcaaaggtagctgatgtgcagctcgatcagctggaatttttcacgatgtgccttcctccacacaaatatcaagccctcagagcatgtatattaaggagcaacagtcatgttaggcatggctcccggaagacaaataagacatgcgcccttaaataactgagagtccagttgggaagacagatgcatacacaaatatttaagaaaatctgtgttctaatagagtctctctaaatactttagcaactctaagccaatttaatttacaagaggtaggcagggcgtggtggctcatgcctgtaatcccaacacttcgggagtccgaggcaggtggatcacctgaactcaggagttcaagatcagcctggccaacatggtgaaaccccatctccactaaaaatacaaaaacttagccaggtgtggtggtggtgcctataatcccagctactctggaggctgaggcaggagaattgcttgaaccaggcaggcggaggttgcagtgagccgagatcacgccactgcactccagcctgggcaacagagtgagactctgtctcaaaaaaataataacaataataataatttataagagatgatattaaacatgaaagtaatatttccctttgaatagataccactaacatatataagaagagttgtgtaagaacaaaactgatatatcattcatttcccccctcataaaccttatgctactaagggtaggggtgcagaattttatttctttaaaaaatgctaataaagcagaagggtttttttagttgttttgttttggtttgagacagggtctcactttgtcacgccggatggcactaacatggctcactgcagcctcgacctcccaggctcaagtgatcctcctgcctcagccccaccaagtagttggcactacaggcatgcaccaccatgcccagataattttttatttttttgtagagatgaggttttgccatgttacccaggctaatctccaactcctgacctcaaatgatccacctgccaggcctcccaaattgctgggattacaggcgttagccaccgcccctggcccagaaggtttattttagcctgattgctctttgtgtgtttctttggattttgctaaggaacttgaagttaatattactaagagggattagaaataaagttaagctaaaacagatcatcagagttaactttagtcataatcctggtcttaacaactatagaaagttttaaagacaaaattgtgatatggttgagactaccaagccatgaagctaaacttaggttgaaagcagaaggtcacattttccattgagtcattccctagaatcagacataaatatccccgacactctttgcactggacacaaaatggataagtcaagaatgtctccgacaattgattacactcactgcaagtttattttggaatgtgccacctcatataaggagttttccaattgtaaagacacctcggaatgatcaccaaaggtgtttgtttgtttcctgggtaccaccccgtagagagcttggttcaggagactagcatgggcccaggaattcgctcattccacaacctgtatcacactcctagtgtcaccaggagggaaccatgagctacagaggcagtaaccggcatgtgtaatcaatatgccagatggagttaaatttcatcaatgctatggctgcttttccattaattttgtcactaagattgtatttccttaaagtgacagccatttctatttatctgaagttaatggttttccctcgtcagcaaaggaactacatcagcatttctttttctttgcacttggtacaaaatagaatcccgtatccccagcatgaggcatttctaaagtccctctcactacagccatccatgtgtcttttgacaaatgaaggaatctcaaactcaaatacctagaagggaacagactttatatgcaatcacacaaccactttttttttttttttttttttttttttgagacagagtcttgttctgtcacccctggctggagtgcaacggtgcgatctcggctcactgcaacctccacctcccgggttcacaccattctcctgcctcagcctcccgagtagctgggattacaagcgtgtaccaccatgccccagttaattttttttttttttgtatttttagtagagacggggtttcaccgtgttagccaggatggtctcgatctcctgacctcgtgatccgaccgcctcggcctcccaaagtgctgggattacaggcttgagccaccgcacccagccaagagatgtagtctcactctgtcacccaggctggagtgcagtggtgtgatcttggctcgctgcaacctcccactcctgggttcaagcgatcctcctgcctcagcttcccgagtagctgggactacaggtgtgcgccaccatgcccggctaatttttgtatttttagtagagacagggtttcgccatgttggctaggatggtctcgaactcctgacctcaggtgatctgcctgccttggcctcccaaagtgctgggattacaggcgtgagccaccacgcctggccacagtttattttcctaagtgccaaggttaagcaagtcaaggaaagactgagggaatgttcaagatgggaagatactgagaagacatgataacacacaagcacattatttgttgagtccaagtatgccaaaatctatttatggctagccagtaactgatcggggcccatttgattttgcaatggcaattacactgtttgttgcttatccctaagtaaatgacacagctatgcctaagtaaactggctaaatgggagatttggtgattgtctaatccgggattgggcaattacatactgattcatggttctgcaaaaataaagttttattagaactcagacacatccattcatttgcatattgtcaaatgccaacatagaagcaggtttctgtcacttacacttaaaatagccctacacagaaaagaacagaaaaacataggagaataaatacgacagactctaaatattcaggaagggaagtgttcaacctttctagtaattaaaggaatacacattctctttttaaaatgggacttcaaaaaactttggtggcatctctactgtgtgtttgtgtgtgtgtcctctgaactaaaattttctacctcaaagcagtggtaccataagcatttttaattctcttaattatacttttctgtattttctgaattcttactaatgagaatccatgacttccatatatttaaaatttcaattttccttttccctttttttatttatttttattattttatttgagacagagactcgctctgtcacccaggccagagtgtagtggcgtgatctcggcccactacaacctctgcctcccgggttcaagcgattcttgtgcctcagcctccagagtagctggggttacaggtgcccgccaccacgcccagctaatttttgtatttttagtagagacggggtttcaccatgttgtccaggctggtctcaaaatcctgacctcaaatgatccacctgccttggcctcccaaagtgctgggattacaggcatgagccaccacgcttggcctcttttttttttttttttttttgagaaactcataatacagcaggtgtgaaacatataggacctagagactaagatattttcaaagaattccaagtatttgatcactcatagggggaagatgagtgaagcctcaatggtgacttcatggttgagagcatattttgttcagcttctcagcacaccctgactgtagcatatttattactgctgtggatttaatagcagcaccagtatcatgattgcatcatgtatttaagatactttaatttattaggtcctgatttgagtgtggtagtggtagtatgctcaccaatatccaaggaccttctctgaagaaggactaaacatctgcacggttgaactcagctgtggccacgtgacttgttttccccgatggaagatgagaatcaagacattttagtgggatacttcatgatccacactgtggctatcattttcctccatctccatcagcctcagtccctacatgactacaataagcagagtcccccggccaacttagcaacacatagttgtaagacattgagcttatttgttcctgcaccgtaacaaagcctatcctcactaacacaagggaatccaggaagagacaccattggggaatctctggaaaggtaaggaggactgcatgaactgtattgcaaaacatatcttaacgatgtgacttaatgttcttttttcttgctatttttacacactgtaattattattcttgatattttactaacttagcaaaaggttctagtgctttttgagcctgattaacaagcaatctgaggggaaactttggctgtatcacaagctttaacattcacagcacaactcatacgatgcactgaattccactgccaccataggagtaaaccacacgcaagcccacattctgtaatgcattacccaacccgcgactccctcagcccccaggctcaggaagggaagaggctataacaagaaccacacaagcggctcttagtaattcttcccagatctgttttattcccattctaagcatgagtttagacccaagattgttgtcttgtggaagctaatttaaatcgtttcattaaattcaggctcagcttgtgaagtgtgcatatcaggggggagaatgtctttgtgctgcatgagggatgtgcaaatagaaagaaaccgtccttcacatcacagtaaaggaagaacccttttcaatataaatttcaatattaattgctggcaactacctccagcaaccgtgcctatgaagggtatataaggaagagtgaaattacttttaaaaaatagattatcatcatccagaagtcaaatagtcccatggtccaaatgtttgtgtccccccaaaattcctaacccccaaggtgagagtattaggaggtggggcctttgggaggtgatgaggtcatgaggccagagcctcagaactgggatcagtgcccttatcaaagggaccccagagagctccctcaccccttccaccatgtgaggacacagcgagaagtcaggaagcccttacaagacatcaactctaccagtgccttgatcttggaattccagcctccggaactgtgagtaataaatgcccattgttaataagccacccagttaatggtattttgttacagcaacacaaatggactaaacaaatagcttctcacaagttcaactgcctcatagcaaagcaatgcacacacatacacaggcgcaaacaccacctacaatggagtaatccatgtatacacacacacacactgcatgccatcttccatgaggcaatgcacatgtgcttatacacaggcacacatgccatccatggtggatcaaagcacacacacagaggccaatgtgccatccaaaatggagcatgtgcacaagcgcagcctgtgcacatggggacatgcaggggacacatggggacatgcaggggacacatggggacatgcagggacacatacagagaaacagacacacgcacagaggcacacacaccatgtgcaatggaccacagcacatgcatgcatgcacaaacgcacacatacaagaaataccataagaagttatttgtatcacatttaaaatgaaatttctacattaccagggcttttccaaaaaaaatgcctgtcttcccaaaccacatcactaagagtttgggctgtatcttgcatgccgatgtaaaaactttcttggttgattgtcagggaatttctgccgtcataacattttcaccatgcttgactgttgactcaatgaggtaaaccacaatgttttatgaaaatacaatttccctttggcctggggcaggcaaggtcacctagcatagcaatgctgttcaatgccaacattgcctgagatgttaatctttggcaaattaaatggcatacattctggctgagacaagagattaggtaaaacagagtgatatcaaaaatatcaaagccacgtgtgtgtgtgtgtgtgtgtgtgtgcgcgtgtgtgtgttctgccatgtcatgtgtagaaggttgaaaagaaactctgccttttaagagtgataaatagccacagggactctcatgggtgaatgtggggataatttcagcattaaaaaagtaataaaacaataacgatggtaattcttatgccacatataataaaaaagaagccaggaatcaagagtgatactcaaaagctgggagtatggaaataaagctcttcttcatgggaggacttcaaccaagaactttagaagaaatgacagcatcatcaatgcaccaatttgtaaccaccaatggactacctcaataaggaagggattacgaacagaacacagtctcaaatatcacgcccaattatcttattccttacacaggaaagaaggtatctgcacaaaggcgagatccgattgacacaaccctccccaacagatccaactcagcaaaagcaatgcaagaacaacttaaccatctgacccctatgaaactcaatgaaaatgacataccaagtcttcttgccaaagatgtccaacccaaatcaaaacatgaggaagcaatctgacaaatatggatcatgggacattaaagacagctggcattcgggcatggtggctcacgcctgtaatcccaacaatttgggaggccgaggcaggaggatcacttgagctcaggagtttgagaccagcctgggtaacatggtgaaaccccgtctccacaaaaaatacaaaaattagagggcatggtggtgtgcacctgtggtcccagctactcgggagggtaaggtggaaggatcgcttgagcctggaaggctgcggttgcagtgagccaagatggcaccactacactccagcctaggtgacagagagagaccctgactcaaattaattaattcattaattaattaaaagataactgagacggacttttcccaaaaaggtcacttccatacaataaaaactaaaggcaggcatattgttttagattttacttttaaatacggtcatagccaaatgcagtgcatgaagcttaactggatttcagacgtttttaaggctgtgaaaggacatcttgtgctgacgcagaaagccctggcagccacccagtggacacaggtgtccagataggtgtggcagtcacttgttgctccagagagtgctcaagttggaggggcatggtgcaggtttgtgagcccctgccttggtgacagcatttgggcaaggctgagacccaagctgtcaggttaaggccaggtggggggcgctgggcacaccaggtgtgcccctggtgacaggtacaggcagcatgcccagacatcctggggctgacacgtcaagcaccagggtcctcacaactatcatttcattttatgttattatttgtatatattgatggagtacaactgtaattttattacacggcttttaatgtagtcatcacccgaataatgtacattgcaccccttaagtaatgtttcatcgtccattcctcttccactccccaaccttccaagtttccgttatctgtcattgcacactctacgctcattgactatggttttgatgcagaagtccctggaagagcttaacacagtttcctccgttgaaccctggcatccttttgctagtgacgccattttataaaagaaaagatcccagcaacaatttctagaagggaaaagacagtttagaaagtcttaggctaatatttggacactatcagactgatcatttgtgcctcaatttttttcacttggaaagacattttaatgatatatagtttagagaattaaattgaatccattgaaactttgtatttatatattagttcatattactaaggattttgtgcttttcacattacgaaggattttgaattttagcactattcaaagggtaattttcaggatgaaatcatatatgtaatgtgctgaactcatgcctaccacactgtaagtatacactacattttgcttacttttcttccagtagagtatctagacttgtgacaatttaatgaagactgggatgggggaagagatgtccctgaatctgcactcctgtgagcaaagcccctcatggcagtcctccaaggttgtaaacttttacatttgaaaggtgcaccccgacaccagccctaatctaatcccacaggacttcccagctacttaagcaattacatcagttgcagtgaaattaagtttacacactgacactgaaaggaaagataacaataaaaattgaaactcaacttcgacattgacaactgggcatgattcacaggctgcaaaactgaagggacatgaattatctccagcttttctcagcactgaagagaagagcatgaaaagggctataaatcaaactttaatttagaaatttcctgggatttcactttcatttatgatcatcttattcccaaaggacttctaagtcactctcatcagtaaaagaaacagataagcacctcacttaagtacaaatcatggctgatgtgtctcaattccctagctcacttcccaaaaatatgtctgcgcctgtcgtttacgtttttttaaatgtgatcccaaataaattttacatttcaggatatgttccaatccaatgaaaatcaattctaaattaatcatgggctgggcacggtggctcacgcctataatctcagcactttggaaggccgaggtgggaggattgtttgagaccaggagtttgagaccaacctgggtaacacagtaaggccccacctgtacaattttttttttagttaaaatatgaaataagataagttacatcaggccatgctcttagtagataaaatattttaatttggtaaggaaagggatttagcacagcagttctttgtaaaaattattttccctttacccacgacccaagcctctccattgctgtaatttcatctttttttgtttgttcactcgagacagggtctcgctctgttgcccaggctggagtgcagtggcacaatcctagctcactgcagcctcaaactcctgggctcaagcgatcctcccatctcagcttcccaaaccactgggatgacaggcacgagctcctgcgcctggcctcatctcttaaacctgttagacggtgccactatgttttcaatgcactgtgtattcagtgtgccctccacctctataggacccaggacaaaacattacctcctggattctctttgcctcctcacagttgatggcaatccaccccatccaggaggctctgatacagtaaggacccacacattagcagccatatgtatgcttttccttctcccttatttaaaaaaaaatcgagatcctgccaacacttttctatgtagtacttgaaccatcttgcaaagggtaaattgtctatttaactattatttctcgctctgtccaaatcaataaggcttagagacacaaagacatgccatttaaaaattacacataaaaaaacctacagaatctctaacgcaagggtcaacaaatccacctgcaagccaaataaggctttataaataaagactaattagcacttagccatgcttatgtgtttatatattgtctatggctggagacaactgagttaaatagttaagacagtgaccctatctgccacaaaacctaagagatttgctactggccctttacagaaagtccactaatcccagcgctaacagaaatgaagtgcacgtagcatgtgtaactttaaagctctcagtagccagattaaatcagtaaaaaaaaccaggggaagataattttatgatacatgttagcccaatatatgcaaaataggatcatttcaacacataaggaatattaagttattaatgagaaatgttctattttttccataaaaagccttggaaatctggtgtgttttacactgatcagatgacatttcgattcagactagccaccacattggtccctgcacatctgaagagcatgccaagtaagaagagaaaaagacgaaaaagaatgcagtttccacttacggctgcagcttcggacaagtccaattgtacacagtgatggtgagaacgtaggctttctgctcatctaagtagatcccaagtaatatttgggacatacttacactgaaacatcattcgttgcattgaatgagattcacacacaaccccgtgtcctgtattttatctggctcccaagcctctgtccctgaatcctcctgcttgtcagtaaaaactcaagtgaggggtagcaagcagaggccaagcctgctgagatgccttccctactgtaagctctgccaaagatgccgccagaagtctttgctttgctcgtgcaggcatttaattctttctgaaaattgctcacaggagcacacccactggccttgtaaatcaattaagaatacattcagctgggtgcagtggctcacacctgtaatcccagcactttgggagggtgaggcgggcagatcacttgagtccaggagtttgaggccagcctagacaacatggcaaaaccctgtctctactaaaaatacaaaaattagccaggcatggtggtgcacacctgtaatcccagctactcgggaggctgaggcaggagaatcacttgaacctgggaggtggaggttgcagtgagccaatatcatgccactgcactccagcctggggattagagcgaggctctgccttaaaaaaaaaaaaagaaagaaagaaagaaaagaaaaaaaaggatacattaaggatacattcatccagcccaagggctgctgggtgtcacgcagaagcccctgccctgtaccctctgaagatgggtcattaatgccatcaccaacaaatgagtctgctagtcgaaacacagaagccatctccctcttaagtaggtttgcttaaaggaaaaaaaaaaaaagttttgtctcacccagaccctgggaacactttacaaagaaaataaaggactgacagaatcaggagtctacaataagagttgactatacggccaggtgcagtgactcacacctataatcccagcactttggtaggccaaggtgtgtggatcacccgaggtcaggagttcaagagcagcgtgaccaacatgatgaaaccccatcaccactaaaaatacaaaagttagctcggtgtggtggcacacacctgtaatctcggctactcgggacgctgaagctagaggattgcttgagccagggagttggaggctgcagtgagctatcatcacactactgcactccagcctaaacaacagagtgagactctgtctcaaaaaataaaaataaaaaaaaaagagtgactacaaataatttttcttattgctgtggaaaaaaataatcatcaccaatgtctcctttttgcctcgagagactataggccagcccttttagaatcagtcaaaataaagagcttgggaatagacaatgagatgtccgaagagtaattttagaacacgagagctgtctgagaacccacatacaaatccaagttgtaaaaagcagagcttgtgtgttctgtttcccatatccgagaaatcggtgacatagctcagtatttctccaacacagagccttccaaatgtggtttcttcctaaggcgactgtaacagagttgaaagcacagggtaaaaattggatggtgtggaacagaggactgtcaggtgagagagcagatggggtctgtggtcgggggactctttgcagatgagtgaatcggtgggcaactgtggcataatcaaagttgtctacatgattcgaataagtaagaatagacccccaaaatgaaggagaagatctagtgacagccacaattatgcacttttactcatcttgaaaaaccatttgggagaaaatttctcacagaaagaacagagaagctttatgtcatgcttttgcaagttaatttccatgcggagtcaaatttctcaccatcaatccattagttaatgattgttcaaaagacgtttccatgcagaatgagggttatctttcagttggaacaaatttttttaaaactctgtgcacattagtgaggtcaaatgaacattacaacccaggagaagactaaaataattccactcccaaaccagaatgttttcttttcagtgtttcccttatcatttcaccgtatagtctcagctacaagtgaggcattgggagggcttgtcaagcgtccagaattctggggatatgcgttcagttctcacgggctcggcatttgtggtggtaccatcttttcctcttattttgctgacagcctgcccacctcgtcttgagatacgttcatcctacaaaccagaatgctcgctccaaaacagaaagcataaaatgctctgcaaaaacaacagcctgcatggtatcagcaggcttctaaaggagttgtttccttctccctgtaccaggagaacatagcccatcaaattctcaaatttcttattgggcagaaagatttcttttcagccgggcatagtggctcatgcctgtaatctcagcactttgggaggtcaaggtgggaggatcacttgagcccaggaggttgagggtgcagtgagccgtgatcgtgccactactccagcctggacaacagagtgagatgctgtctcaaaagaaaaaaacaaaaaagcagacacttggcagtctatttttttaaaacctatgacagaaagaaatcttttgttttttcgtttgagacagagtctcgctctgttgcccaggctggagtgtagtggcacgatcacagctcactgcagcctgcacctctcaggttcaagtgattctgctgcctcagcctcccaagtagctgggattacaggtgcacgccactatacctggctaatttttttatgtttagtagaggcggggtttctccaagttagccaggctggcctcaaactcctggactcaagtgatccgccttcctcggcctcccaaagtgctgggattacaagggtgagtcactgagtcaggccaacagtctgcattttttacctcacttgaagttatcttgtcctgtgtccaatctataattccttaataagaggaaataaaatcatgatgaatgcacttaatgccactgatttgtgcacttaaaaatggttacaatagcaaactttgtgttatgtatattttaccacaataaaaaataaactaaaagtgaaataaaaccaaataaccataaaaggccacccccaacaccaggtttatggagagtcttgtgttcccagcacccaacggatgccaaagtctgcttttcccccatgagccggagttctggaaattgatctccccactaagcagcacactgtttggtcatcctggccattcagtcctgtctgggaacgcggccataatttaaatatgctgttaaaatgcagagctatctattcacagcatggtctagttatttagccataaggtgtagacaaacagaattctgtttaaatatttccgcaatatccagttacatttccaaattccatgaccacagctcatgtttccccttcgttattgacaatcataagcaatttctgtgcaatgggaaatggtggctattttcataagcaatcacattctttaatgagttttttttttttggtctacttgcaggtaatttataagtaggtgaattttgacttttttttttttttgagattaagcctccctaatataatcccactctccaatctgctgtgctggttgactttggggatggttgtcagctctgtgacttggttttgtggcctcttgacagtctacacagggcactccatggacttggaggaagacgggagagtccagaggcaaggaggatactgcaggactgggactgaataacaaagaaaacgccagagagactccaggagagcaagatcggttcacacagaagaacgacgtacacggcaggcacatggggccaggaggccatacagctgcggctgtggaaggtcagttcaggaagggcctatattcctggctgaggagtttagattacaccctgcagggaaacgggagaccacagaagcgttttcagcaagagggtatacggtgagctgaatagcaagtaccaaaacatacatctaagtttgaactcccagaacctcagaatgtgaccttatttagaattagggtttctgcaggtgtaattacaagaatctcgaggtgcgagcacactgggtttagggtggtccccaaatcaaatgactggtgtccttataagagaaaggagagggagattagagacagggacaaaagcaccatgtgaagacagaggcagagactggagtgacagtgagtctgcaaaccaaggagtgccaaggattgctggctccccccacccctggaagctaaatgagctgcatgggatggagtctcccccagaagcttccagaagggaccagccctgccaacaacttgatctcaggcctgtggcctccagagctgtgaggaaagcatttctgctgttgtaagccacccccagttcatggtaatttgctacagccgccccaggaaatgaacacagattcacatcgtcagatgcgtatttcagaaacattactgcggcttctgtagaggaatatagcttgaaccaaaagaggcaagcgttaaagggagaccaatcaggaaaactaacgcaataattcagatgagaactgaaaacatccggttccacacaaggacaacaaagatgaggtttaaggcaaaggacttgcacagacatcgtcagattgtctcatgtggggaagggagagcacaaagacaaggataggaggtactagaggggtgcagggcacaagcgcgggtgacctggaaaaaacaggacaactgggccctggaacggcaggcatgaagggcatggatgtagataaggttccttgctgctaagctaagaaatgaaagaacttcctgcccaatgacctccataaagaggcaaagccatctgctgagaatgtgcagggaaggggttgggggaagcactgatcatttaacaaaggatggaagacagggctaaagagggatgcatagaatcgcttgctctcaggagggcccagctggggttgaagatcacaatgctgtagtaacacagatttgctcagttatgcaatttttccttagcagccatcaactgcttggatgtggaccaaggaaggcagatggctgggctgattcaagactgggcttctgcacagagtgatgcacatttcagtttgtttccaatatgagctctgttgcactgatcgacttcaatgaattctctacagtaaacatccagtacacaaggtactctctaacggatacattgcgtaccgtcatatgtgggatgctatgatagcattgagaatgaatgagctacagtgacagcagataggaacattgcacatacaacgctggtgacagatgcaagaccccagaagatacatgctgtatgattccattaatacaaaattaattctttttgagaatgcgcacatagagaaaatgattaaaaaaaaaaaagtaaggagatgatttccccaaaagcccaaatagtggtggcttccgatggtgagagacttctagcgcaatgataatcgcaggaggctcctgagcaaatggcaatgttctgcctcttcacttgggaaatcactggttcaataacatgtatatgtctctggaatgctctttaacacttataggtcataagtcacaacaaaaaatgaaagggaaggaggaaaatgctctgtggctccaacagcatcaaattatatatatatatatatatattttttttttttaattttattttttattttttatttttttgagacggagtttcactcttgttgcccaggctggcatgtaatggtgcgatctcagctcaccgcaacctccttcccgggttcaagccattctcctgcctcagcctcctgcatagctgggattacaggcatgtgtcaccacacccggctaattttgtatttttaatagagacggggtttctccatgttggtcaggctggtctcaaactcccgacctcaggtgatcacccgcctcggccttccaaagtgctgggattacaggcgtgagccttcgtgcctggcctataattttaatactcaacaaaatagaggttagtatttcaataagccaagaacatttttcagtcataagcatttgaaactaaagtcaaatggggctacaagaaagaaagagaaaggaaagaaagaaagaaagaaagaaagaaagaaagaaagaaagaaagaaagaaagaaagaaagaaagaaagaaagaaagaaaagagaatagaaaagaagagaagagaaaagagaaaagaaaaaagaaaagaaacacattggttcacataactgcaaatgtcatgtgtggtcttcaggcttggctagatccaggtattcccatgctatccagagaggtgtcaccccttagctccatattcctcagtaccattttcggtctcaaggagtgataagaatgatgggatttttttcctcactgggtttactggtacctgtttagcaaccctagcaaaaagaacaaacaaacaaaaacaaaaacaaacctttgtcaagaattctaatagaagcccagatctggctgtctctgggtcacgatttgggttaagaagtcaccgtagacaagaaatatgagatgccgtttggccagacctgggcccccggcgctggagctctgtatctcagggactgagaataacagcctgtgttcccccagagaaaacttgagttgttttaaccgaaagatagaggccgaacacggagtcagacaaaaactacccacgtccactacacatattttcaccttcctttggtgctatcaccaagcagcaaatttccgttcatttctcactcgtatatttcaaacaccttccttctcttccaaccctccctgacttaagaagctaaggcaaacaaaataaaatacacacaaaagaagcaggagtttagaagcaggaaacaaaaggcatgaaagaatgagtgaatgattccatttcccctgcctctggcctctagtgaatcacctactggaagtttgtgcaaaaagtctgcattcactcaggtacggaattcctaggaaccctcatagagattcctgctggcgtagttccatagaagagaagacttggcgcctccagggactctcggctgttccttaaacagagatgagcaccatcctggctaacacggtgaaactccgtctctactaaaaaaatacaaaaaattagcccggcgtggtggcgggcgcctgcagtcccagctactcgggaggctgaggcaggagaatggcgtgaacccgggaggcggagcttgcagtgagccgagatcgcgccactgcgctccagcctgggcaacagagcgagactccgtctcaaaaaaaaaaaaaaaaaaaaaaagagaaaggtgggcttgaataaagggggaaagatcgtgaatggcccgaaggactccggagtgtcctggacaaagtgggattcccccagagggaaaggacaaactctgcctacagctgaccaagccagccggctcccccagggctttgccaggaaaatcaccaccacaaatgtctccaccatcatgtctgtggttccttgaatcctttatgcttctgttgaaactgccaaggcaggacttgaaggcttcgctgtgcaaattcaaaagcattctgagatcatcaactctctgaagtcaccaccatttggaaccaaaccttaaaagaagccaccgagatggaagctccaatacactttcgcctctggtcatctccttcctgagaaaattcatgatatcagatcatccacaactttgatatttctccccacatttctgagtttttcagtggccaaggagaagactccgtctgtttcttaataattactgataatcgtttcaccacaaaagatactactttggataaacaagctttgtggtttctgtcaagtacaaacaacgaagattaaattagcatcttgaaaacccacagggtgagcttgctcctcccctcctttaagtctgcagaattacctggggctccctcccaggtgccaagcacacagatgtgagcaagacactgagacaccactgctgccctgcgctatcactagggaatcctgtgtccctagcagcttatccagctggctctcaggctatggtgaaactgcaatacagaaggaatattccaaaagagaattaaaaatgcagctgtcatatgggcgacaggcccaagtctagcagttaacagctaccccgcccccaccccgcccacttccctgggagcagccctgctctccagtctgcaaacccaggggctgaggggccggggcatcccgaggcctggatgcccaagggatgcaaactccttccccaccctctctgcttcccttatcaagcctcctaagtgttctccccatcccataatggggaataatccctaaaattcaagggctgaagctctaatccccactaccttttggaatgtgaccgtatttggaaacaggatctctaaggaggtaattaaattaaaatgaggtcattagggtgggccctggtccagtagtactggagtccttataagaagaggcgatgaggacacaggcacacacagagggacgaccatgggaggatacaggccgtctacaagccaccgagaggggctgcgggagaaagcagccctgtgacacttgggtttcaaacatgtggcctccagaatgtgagggaatccctgtctgctactctggcatggcagccctagccggctcatacgggcccatcccccactcgccatctcaacgtggagaccctacaggaactcatggcccgggaaggccttttggtcccctcacccctattttcaaagcccacacagttaaaatgcaggggggcttcttgctcttaagactgaaatggtgcagctccctacacccgtctgtgtccacggccatccccagtatagcaaacttacatgtgacacccagctcggtatttcccctctcaggtcccccttccccctcctacagacacatccccaaacccttttaagatgttgcataacctggctccggaagccaatagagtttttactgaatctggcttcacataacccaacagattgtgaactagacatttgccaacttttcccccgtgccagaccatttttaagttatgtgtgcacagaatggcatttaaaggacttaaataactctccagggggagaaaagagcagaaaatagcccacaaggctcctataaacgggggcaggaacagcagaaacagaatttggggcgagtgttctgcttgtttttagttgcggcgggaggggcttttctattaggttgtgtttttgttgtttttgctttgggggtgaaaaaaggggacagagaacagaaaggaacctagtttatagtgacagctgtttaggaaagtcatttctagattagaggggagagcccctaggggctgcttctagattccactccttggggttggaggggccgggtgagcaggctttggggagtgcctgggtgactaccccaaccctgcctcaacggcaccccctccctgtgcaccgacaaataaatggtggctgtaaaaaaaaaaagaaataaatgtttttttaagcagtgcttcctgttatgttcaaggaagactagggccgttttattattaagcaattttctctttttaagtaaacacacacacgaccacattgctgcaaggctaaaatctcttgccttactcaagcatcgacgttttcaatctcctattttctcaagccctcaatgaagccttccaagagcttgcctatgtttaatttgcattccgaaacagaaaatctaatgtgttttaacattgtctgcttcagctgaaaaggaaactgtaaatttatacagtctggtttaaaaaaaaaaaaattggccattgcatctaaatgagtctcctccggaaagaggctgggtggcgcccctccccctcctccctctttcacttcccctcccgcttctccctctttcacttcccctccccctcctccctttttcacttccccttgtcctccctccctcacctcccatccccctccctcctcctcccctccccctctgcttttcaccccctccctcctcctcccctccccctctgctttttaccctccccctgctccttcccacctcccctccccctcccccgctgctttcaccccctccctccttccctccccctctgctttcacccctccctcttcctcccctccccctctgctttttaccctccccctccttctcccctccacctctcccctccccatccttctctgcttttcaccccctccctcctcccccctcctcctccgttttgcacccctctctcctccttctcctccccttccccctcctcctctgcttttcatcccctctctgtccctccctcccccctcctagcctcctctccctgcattggagtttaggccacagcctccctcctccctcttagtcttccagcctcctcccctcccctcccctctcttctcctcccctcccccaggatcagactcggggccggtctgtgccagcgccctacgtggactgggaaagaattaccgaggaccttagaagagctgcgcactcgcagcgccccgcccccacgccgccggccgcccgcgcgggtgtctccctgtgctcccaaaacacggctcaggttcaccgggtcctcccccggggatctcagggctgttggggggtgctgtggttcccagaacgccgcgacactctgaaacaggaaaggggacggcagaggggtcctgctgcgggggagcccttgagaaggcctgggtggagagggacttggggacagaggtaaagaagggagtctctgggggtgaggaagtgcctgggaagggcacgaggaggagttggggaagggaaaatcaggcccaaagttttagggctctgtctctactgaaggtcaaaaagggttcctgcagggcagtgggagacctgctcctgacgaccccgtcctataattaaatccctgagtaagaacactccagagttggggctcagtagctgccgtgtgcacctgcgcatcagatgccccctaagcgtacccctggaagcctctgattctgtgtcatcacggcaggaggggattcgaggagttttggaagacgccaggatgacgttcttaagccatctgatgggtgaaggggcttcttcacttcgctgtggcttcactacttagatgttaaagcggcttctcttcctaataaaaaacaaagtgtagccacttttctgtccaagaaaataaaaattcccagagaaaaccaacgttgacgtttgcattcacgacgtgcctgtcgttttcctctgtgtggaagaattttcccatccaaaaatgggagttgaggatggaggtgaggtaaataataaaatcgggctcactctgtataaatagttcagcattccgatttggttacctagtattaaaaaataaatatttttctaggtcactaaatatttttcaaaattatactttaaatgagggcttaaattccaccgcgtggaattgtatatgccagaatgtagtaaccatatccctcttgcacagtattcctcttgtttaacatttaaggacggtatcctaagttattccccattgtgtagtcacataagtcacctttttcttcactagcttcagtgcaagaaatgaatacagtttcctctgcaccatgggtccgtctgttgccattgcctgcactggggttgtttggaattcctgtctgaaactttctagagttaaaggcagaaaacattggccaagtttccaagcctaaagctgattcttgaccttagttagaccttatgtcagaaaagagggtgacagctacttgggaagctgaggtgggaggattgcttgagcctgggaggttgaggctgcagtaagtcatgatcgtgccactgtgctcacgcctgggtgacaaagcgagaccctatctcaacaaaaaaaaaaaaaagaaagaaaagaaaagagggtgagcaaaacaggacagtagggggtgctccaggtgtctggggggggggcatcgccaatatcctaatatcccagagcctcgggaggagccctctctcccaaagcactgcccgccacattctggggatgtcctgcaaagcctaaatattggcggtggggagtggaaatgttcccttctgttatattctctactagagtgttttgcatgttgatatatatacatatgtgcatttcagcaagatggtggattttattttttcttatttttgagatggagactcgctctattccccaggctggagtgcagtggcacgatctcagctcactgcaacctccaccttccaggttcaggcaattctactgcctcagcctcctgagtagctgagattacaggtgcccaccaccatgcccagctaatttttgtatttttagtagagatggtgtttcaccatgttagccaggctggtcttgaattcctgacctcaagtgatccgcccgcctcggcctcccaaagtgctagaattacaggcgtgaaccaggacacccggccctgagtgacatttttttttccttctttgagatggagtctcgctctgtcaccaggctggagtgcagtggcgccatctcagttcactgctcccttgaacctccaactccctggttcaagggattctcctgcctcagtctcccgagtagctgggactacaggcacgcgccaccacgccgagctaatttttgtatttttagttgagacggggtttcactatgaaggccaggatggtctcatgatccaccgacctcgggctcccaaagggctgggattaagggtgtgagccaccgtgtcaggccaaaatgaaaggcacaaatctcaatgtgggacatgatttttggcatcacagtgaaagaaaacagtcacgtgttaatgatgaacttcacaggcctcaaagctcatggcctgagtttatgaagagtcccccaggagattggtggttggcttgaaggaacctctctttttgtgttcatcacacaacttgatgaggaatattgaatattgaacataaaaagaagaaatttgagaacaatacacagccttgccttccacaaatcatcaccccttgacttccatttctttagtaagaaagaattaactccagagccattctggtatcttcagaatgctggttcgcatagtggaccttcagttcttttaatcaataatcaataatttaatcaatcatatcaatgttacaatgtgatcaaccatatctgtctacccaagagaaatgaaaacatgcatccacagattcctagatgaaagctcacagcagtatcacccatgagagccaaaaagtggaaacaatccaaatgcccatcaatggatacgtggatatacaaaatgtgctctatccatacaatggatgttattcagccataaaaagaaatgaagttctgaaatgccaaaacgtggttgaaccttgaaaacactatgccaagatgcaaaaaggctacatatcgtatgatttattttataagaaatgtccagaacaggctagagacagaaagtagaacagtggttgttgctggtgaggggaggagaaggatgggaagagactgccagtgggcacaaggtttctttctttcttttctttttttcttttttgagacgggtccttgctctgttgcccaggctggcgcgcagtggctcaatcacagcccactgcagcctcaacttcacaggctcaattgatcctcctacctcagcctcgctaatagctgggaccacaggggcacaccaccacacctggctaatatttgtatttttgtagagatggggtttctccacattgcccaggctggtctcaaactcctggactcaaacgatcccctcgcttcagcctcccaaagtgctggaattacaggcaggagccactgagcccagcctgcgccaggtttctttttggggtgatggaaatgttctaaaattagattaccatcaggattgcacaactctgtaaattactaaaaacaaaacaatgaattatgcagttacaatgggtgaattttacgctatgtaaattgtatctcaagaaactcttctagagtttgattaactctcaagtttaaaaatgttatagcgttggccgggtacagtggattactcctgtaatgctagcacttggggctgccgaggcaggtagatcgcttgagctcaggagttcgagactagcccagacaacacggcaagacccttgtctcttaaaaaaaaaacacaataaaaagttatagtgtaacagatcatttttgcaggcactgtctccaagtgaaaaaaggcccctattatagacctattaaaggcaaaataccttcaggataggccactctaaagctagcatgtgctagagcaaatctgtgacaaatcctggctttttcttcaagaccatttctctgctttcctacttgggtctaagccctcgttgctttgggaatgcacttgagctcagtccttccagccttttctgccttcctgctggttcccaagacactctgcaccagatcatctttgccatggtgtttcgctgcctttcccatatgccatacaaaatcatccataaattgctgggcacggtggctcacgcctataatcccagcactttaggaggctgaggcaggcggatctcttgaggccaggagtttgagaccagcctggctaacatagcaaaaccctgtccctactaaaaatacaaaaattagctgggcgtggtggcacatgcctgtaatcccagctactcgggaggctgaggcaggagaatcccttgaaccagggaggtggaagttgcagtgagctgagatggcgtcactgaactccagcctgggagacccagcaagactctgtctttaaaataataataataaatataataataataataaatatataattattatatatataattatatataaatatatataaataataataaataataaaataataataataataataccaatccatccatttatgtcactggcgatgtatgaggttaagcccggcctccttaggctctccttgaactaacctcatctgactagcgtgagctgtttggtggttccttctcccccaggaaactcccatccacagtaagaagtacatttcacacagaaacacaagacccacatacacatatatgtgaccaaaatgtgacatgatgctcatgaacttatccttccccttgccatgggctcattctataattttctgggctatccacttccatttcatgctttcagtgctagtcactacccactcaactgaatgcacaaccaactaatttttgagatacgcacctcagcaatttaaaaagctttggtctagaccagtggccctcagccagcagggattttaccccacaagggatattaggcaatgtctgcagactttttgagttgtctcaaacaggtgcggggggtgctcctgacatcccatgggtggaggccaggaatgctggtcaaccccctaccgtgcacaggacggccccaccacagagcatgctccagtcccaaatgttcacggtgctgacatggagaaactgtcgtctcaactacagaaaagcctcagtctcggcctggtgcagtggctcacccctacaatcccagcactatgggaggccaaggcaggcagattgctcgagctcaagagttcaagaccagcctgggcaacatagtgaaaccccatctctactaaaaatacaaaaattagccaggcgtcatggcggtcctgacgcctgtaatcccagctactcagggggctgaggcaggagaatcacttgaacacagaaggcggaggttgccgtgagccaagatggcgccactgcactcagcctgggcaatagagcgagactctgcctcaaaaaaaaaaaaaaaaaaaaattagccaggcatgcatggtatcaggtgcctgtagtcccagctactcgggaggctgaggcaggaggatcgcttgagcccaggaggcagaggttgcagtgagctgagaccacaccattgcactccagcctgggggatagagtgagaccctgtctcaaaaaataaacaaaaaaaaagaaaagaaaacgctccagtcacttcattgactaaacagatcttgtagttaactctaaaataagttggaaggagaattctcagtaatgaataaaagagagcttgttcctgcctctccttcccccttctcaccaatatctccatgcttgatgttattaatcccatgtgtgccatgtagaccccagccaactttggatcccagccacagtctctgactgtacagttattatttaaatgagggctgatttgcagtggatttgcacaggcgtcagttgccttagcttatgtggagcggtgttggtcctatcccttggtcactgcctcctgcacagctaatcccgcttaccccacatctaaaccatgtgtcctgtgatgctccagtctggccccacattgggggcactctgggagcttcaaacactcccaccacccaggtcccactggcagagactggggtttcattggtctggggtgtggcctgcacatccaaattcttgaaagctgcctggcagctttcaatttttttgcctttttgtactggcaaggttggagcttcgtgatacactccttccaacactcccaaggcagggctgcatgcctccactttgctcccattgtgaacattctcagactgcacattcctctgtattttatgatagagacaaacccacaatcgccttttgggaggcatgctcctataagttaatattctgaattctggttcatggaagcttctcctggggaagaaataatgctagattattgctggggaatggaactgaataacacttctaaaaatagaatcgtttatgtaagtcaatcctggcaccactggcatttgggactggataattctgttgtagggggctgctctgtgcactgtaagatgtttggcaacatccctggtctccatcactggatgccaggcgcgccccgcattgtgacaaccaaaattgtctccagacattgccaaatgtcccctgggatgggaggagcaaaattgcccccagttgagaatcactgacttaagagtatacagaaatgtatttctgctttgctgatttttaactacatgaaaatacatatatatattgtcaaaatattttccaaccaattatgtaataccaagtgtgctgtgttttgttgaggtgggagaaagaaccatacctcttcactgaggttacatggataactgctttagaagatccattggtacactgagttctgcaaggaaataaaacatttctaaatttaaaaaaaaagaagaagaagacccatcgtaagactaactggaaaaaagacacgattccattcacagcagagcatggtaatgagctcaatgaaattagcaaagaccagggatctggccagtccttgttcccgctgctggctgccgaccagtccctggggcacctcctgagtgccattctgccttctcactacacgttcctgtctttgggggaatcatgggatctctccccttgctgaagttgtcccttcaaacacctggagagtagcctgcctatgaggaacaagacatggcagtttggggacagtgtgtcacttctacattacagagagctgttgcgcatgattccatccaactgcttgtcactgcacagagctgcactggggaaacaaataatgcataactatttttaaaaaataaacagagcatccacgggtttttaaaatgtaatctgcaacatttatagaactatgttaggaattataaactatgttaggtgagcaattggccatctgaatgctttccctgtgaattgtttgtgggggaatgagtcatccttttcccctttcttggacctgcatccattatcctgcagtggagcgatgtgttcatatatgacttacacatgggaccagctgcatgatttgtggggcgcagtgcaaaatgtaaatttggggtcctttgttcaaaagcagaaaagaaagatttttccttccctcctccccagtcgttctggacctgtcatggtgttttttcacttattcttattattgttagagacaggttcttgctttgtggcccaggctagaatacaatgacacaatcataggtcactgcaggcttgacatcctgggctcaagcaatcctcccgcctcagcctcccaagtagctggaactagaggcacacactcctgcgcctggcttttgctttttactcttaatgcagcacctctttgggcatagggatactcggagggccaatgtggactctcacaggctcccggggtcccacccacgacttggcaggtggggcacatgcctgctgacctgaacctctccgcgcctgccagaaggcagagagtagccacatcattggatgggggcagggaagtggagcacagagagtccatcctgggaggcagggaggtggcacctccaagccctgggctcatgctccactgtcctgtcagaccgtcgctttcaaaatacaaactcaaagacaacatgatgaggcattgcaatatggaggttgcagaacattaaaccagtccatgtgggactgaactgtcacaaggcagcaaagctggccctgcttacacataaaatactagctaatctctatataatcagggaaaggttacattagaatgttttccaaatcacaaggatgatactataaccagctacccaaaacattcatacttttaggttaaaatttacattttagtctccttgacgtctgggtatttggaaaaaaagaaaaaaaattaacgttttaggcacttccatttttctcgagagccaaaattttccttttgttttcattattaatgtctatacaacgaaaacatgcatcgtacatttttaaaatcgactttccttttgctgtttttgccatacatttcctgactggtttgtaaaacagccaaaaagaactgaggagtggtagcttatgctatgaccaaaaaatatacatttcacaaaattaagttgtcccacgcttgaaaataaaataaaatcacttgccagtgactttgaatgtggctaagcagtgtggcttgccaattatgaggtgtgaagataaaggactgtcacgctaaacttgtcttctttcatttgatgtcagtttctcagagtagggaccttgaaccacctgtactgaacttggaaccacctcaacctgcccagctccatggatcccagctccagggtgagatcttaggtgactgcctttgtaacacgcatcacaggtggctgaaacacacccacagtttgagacccactgtctggtctaacatcactctgtcctcggagtttttttttttttttttttttttgagacagagtttcgctcttgttgcccaggctagagtgcagtggcgcgatctcggctcaccgtgacctccacctcccacgttcaagcgattctcctgcctcagcctcccgaggagctgggattacaagcatgcgccaccacgcctggctaattttgtatttttagtagagatggggtttctccatgttggtcaggctggtctcgaacccctgacttcaggtgatccgcccgcctcggcctcccaaagtgttgggattacaggcgtgagccactgcacccagccttgtacccggaaattgagaacaacacaagcccctcccagaaacactacacatcctctcttgttgtggctgctgaacttactctgacacattccttggctgaaataccagcaagccacagacacaccttgcctaaaggcgtccacaacaccactgatgcaagcagtcgcacagcaaaattttgcggccacagggatccacctgctggcccacaactcacatctctggccgcattgggttccaagtgcgctcaggagttaatcacacaccctttcttcttggcttctctcctctcctgaggcaggtattacaaatacaaacacccatttccttctctgtgtttatgctttcttggcacaattcctacttgaaaggtaggaacaaaaattcaaaatgcaaataccctcagctcaggaatcacattcttatcttttcttaggagatgacttgtttttaactttaaaaaatcctcaacataaaaaaatggtttttgttacattcttgagacagaaatctgctaacttggcaaattttttttaaacttattcctttcgttatggtcacacacacctttcttttctaggggcagcagtaatttgcattagacacgacgcacacttgctttcatttctcagtgtctaaaataccatcttcttgtcacttctctttatcaagccatgcacctaacaatgacttgttcgcttcaggagactcaggaaaaggagctgctggtccttgttttatctgcacatttcttgaaggatcccatccagcaaaacctggcctgccttccctggaattttaattttgccccagattgtgtgttggttttattatttaaacaaattttaaattacaggagtacaaggagccctagaagcaaaagaaactattcagatgactgcttagaagctttcgtaaattctgcaaggtggtgataactgtcgatgactcggcaggtttttcggagaaatgtacaggaagcgaaacccactgcgtgtctaacgggtccagtatgtcattgtgcaacgtcccacaggccttcaatgtcctcagagctattttgtgacctacacactgcatggagatgccccaccggctttgattgcaccctctagcaaaagagatttccctgcagcttgaatggggcaaagcaagttctttgaaacaacaaccaaaaagatgcgggttggggagaaaagcttggctctttccccagactctctggatagcgcagctttccttttttctatcctcctggctttttgttctccatcattactctgagtcagcaaggaagaaatggcaagggactccggaaaaacatgtgtgatagggtgcctgagcaaaaggcaacatttcatcagttctttttatgaatcagtctttgatttggggatgtactgtccaaagtgaaagactccttggagatttgcctggtaagagagagacatgtggtaaaccaattcaaggtcaggcagatcgggcttgggttgcataggtttttgtagcccagccccccaggctctccactcaccctacagcacgcattagctgcgtgtctctttgcatagagtcgcttttcataaggatcctaaggtgcaggggagcagcagccaaggacagctgcccaaagtagcctgcttccaggactgcaaagaaatggaaagagcagcatgaaaggacccagtcatggcctggcacagtggctcacacctgtaatcccagcactttgagaggccaaggcggccggatcacttgaggtcaggagtttgagaccagcctggccaacatggtgaaaccctgtctctactaaaaaatacaaaaattagccgggcatggtggcacgcacctgtaatcccagctacttgggaggttgaggcaggagaatcacttgaccccaggagacagaggttgcagtgagccaagatggcgccactgcactccagcctgggtgacagagtgagactctatctcaaaaaaaagaaaaagaaagaaagaaagaaaagaaaagaaaaaagaaaggacccagtcacaccaactaacccatcgatgtccaacagggggctacgcttggttacaaaacacatacctgcatgttgagaaccatacaaatagaagtgtgtgggccaggcacaatggctcacgcctataatcccagcactttggggggcctaggcgggcagatcacctgaggtcaggagttcgagaccagcctggccaacatggcaaaatcccgtctctactaaaaatacaaaaattagccaggcatggtggcaggtgcctgtaatcccagctcctccggaggctaaggcaggagaatagcttcaacccgggaggcagaggttgcagtgagccaagttcgcaccactacactccagcctgggcgacagagcgagtctcgttctccaaacaaacaaacaaaaaacaattagaagtgtctgtgcaatactagctaatattctgcctgcatttccagccctgctgactcttgtacaggacctaaggtcaacagttcttgggctctgaggaactttgcttctctttctggcctcagctccacaggctccatgaacccaggtctagggatctagttcactcaaagggactacgaaatcaagctaagccactcagtattcttatcgtatcctcctccaaaagcaacaagatgtatgctcaagaaataagaagactctagcaagcagaccagagtgtgtctggcataactctttttggaataaagtaagcgccttctaattaatggtattgctcctgtaggttttcaagttttatttaattgaataaccacttatgtggcgaagctctatgctagcattgagagaagagagacagggatcctaccattgagtgggtggctttgtaaaaggatctgcagtcagtgagaggaatttacaaacagccagagcattcacaaagcaaaggaagaagtttacaaatatcggtatctacgtaggtgagaccacagcggctcaagatccctttgcatcgggggttggtcagagcttcaggggaatcctttggaatctcatctcattaaggggtgctcagagctctgccccagacatcctgagacccagttcttgaggaagtcgtccatcggtgcccaggcaagacaggtaaggatgggaggtcatgcgtgtggagtgccatgaccgggccacgaagtgcagcagctgtgtaagggggtgatccacagctaggcgagcttcacagtcatcctcggatatgcacagagtggtcaaagtctttgaagttgctcaacatgcatgttcccagctgaggtcaaacgaggagaccctctgccttcctgtttcagctctcattgctgtaaaccagtgtctttttcacagcctacctcgtgccatgttttttgcatgtttgtacttctaactaattatttcacttattaaaatggttcccaagtgtagagctgaagtcctgtcttctgttcctaaaacaagtaggctgtgatgtgcctcacagagaaaatacacatttgacagctattattcacgtatgagttacagtgccgttggccgtgagttcaaccttaatggatcaataacatatattaaatgaggtgtcttcagcagaagacacacaaaacaagattgtgtattgatccgttgacaaaaatgtttgacaagaggctccaagaccccgacctgtgtgtttctcctaggagcagaagtttagtatttgctaatttggtgcgcatggaggctgtagagaacaccgctactttgaataatgagaattgacggtatttgttaaacgaattaaaggaagtgtgtcagaagagggatgaggaaaatgttctgggtgttcagagaccacttccaatggggggaaccagggagagcccactggaggggacacgtgtgagctgcgtcttgcagagtgggtcagacatggataaatattggtcatgtacgccctgaacggtggaatggcatgagcacaatcccgatgtgggaaaccttgacacttgtacatagagcttgccccaagctcagaccctttgagtctcgatggcagttctatgactcacaggatgtgtgaccttgaggaagtcactcagcttccggtgaggtggggttaacaatatcacctatctcatgaggttgctataagtaacaaaatagattacatcttaaccaagagcctggttggtgcattgttaaacgttcaaaaccattcagttatttctgttgtcattattctattaccaggtcactgcatatttccatttggctcaatcataaggagttcgaggaaaaattgtgggaaatagggctgtaaatacgggatgaagtcaagtcccagcggaccttggagtctaggttaagaaactgagggctttttttacaccatagctctggacagcaagagtgggtttttgtaaagagacagacatgatagagttgtgttctagcctgaagctgacagtgagaacagatggggagaagtactgacgggactgagggacaaaggagaagagggcccaggaggcgtgagggctccaggataaaggggaaaggaggacatcaactcaaaagaggcagaagggcgtgcagggcgctggcggtgttctgcgtcttcacctggtgccgcttccagggaagcattcagtttatgagatctggggagctgttgacttatcaatagtgtgcttttctgtatgtagatggactttggtgaatttggtaaaaagtgatggaaaggtttcaggcaggatgatgagttagaggagggagcgatttaagtaaacaagatggaagagggacagagttgggtggggacgacactgagttcggttgcagcaagttgagtgggtttggatggaaagctgatggccccatgctgggaagaggtaccatgtcaaagccaccatctcagaatcaagaatctggaggtagggttataattcccatggttcttaagtgaagcacgaaaaggaagggaaggaagaaggaaggaaggaaaaactggccttattaggtagtaaaactcaggaaattcaatgacagccgggccagcattcctgtcttctcacatatgaagaaatacaggtttctgtgtcctgtataaatctggttcccagtttttcctatgaaacagggatgtaccgcagcctgactaaaattctaatggaatgccaagaagttttgccagtgtcttagcttttactggtaaccaccaactgtccaggaagggagaaatagatgtccaaaaagaagcttttaaatgtcttcattcttcctctgttagtcagacttatttcactttgggaattaggctaaagtggaagtggaaggtgaaagtaaaaaagcaaattctgaccgggagcggtggctcacgcctgtaatcccagcactttgggaggccaaggcaggcagatcacttgaggccaggagttcaaaaccagcctgggcaacatggtgaaaccccatatcttctaaaaatacaaaaattagctgggtgtggtggtgcatgcctgtgatcccagctactcaggaggctgaggtgggaggattgcttgagcccagaaggtcgaagttgcagtgagctgagattgtgccactgtactccagcctgggtgacagagcaagatcctgtctcaaaaaaaaaaaaaaaaaaaaaagtgaaatcctatttgtcatccaaaaccaagcctgttttctgttttcacatgcttaagcaagtgatcagagatggcaactgtgtctggtgtcctggtcttagttaacctgtgtgtactcattaaatagcagggggtatatggggcgcttatttcaatgaaaacaattacacatgcacattttgtctgttcagcattaatgattccctgttggcagagctgcacactgggtgcttcttgggcttcaaagcaagcttattaaatagaaatgactgtcaagtcttgtaatttgggtaactgccaaacagaccacggatgaaggcagaaaaagaagaaaataaagactgattacctgcagcacttcttgtttccactaccagaaaaattactctggaggccccagtgcttatctgctttccccatacagcttccacgagggaaggcctcctgcgtacccaagtgggaccatctgagcttctctctaagcctgaacattgtttctaagctacctccagggtaccaaggccaggaggaagggttaattagggcaaataaattcagaggaagcgctctatgtgcattatcgcccttattctagagccgaaggagtttgtgaatctacccaacttcccaccataccgtttggggatctgtatttgattttcatagtctcactaaaaaaaagatagcattccccataaactcaaaaaatagttacaaatacaggttgaagctaggcacggtggtgcacacctgtgatcccagtgattcgggcggctgaggcaggaggatcacttgaatccaggagttcaaggctgtggttagctatgatcgtgccactgcaccccagcctgggtgacacagtgagactctgtctctaacaatataaaataaagtaaaatacaggttgagaaaccctaacccaaaaatccaaaatctgagatgctccaaaatccaaagcttttggagtgcaaacacgatgccacaagtgggaaatttcattcctaacctcatgggaggggtcacagttaaaatgtggttaagactttgttttatgcacgaaattattaaaaatattatataggctgtgtgtggtggctcactccggtaatcccaacactttgggaggcctaggcgggaggatcacttgaacccagaagtgcaaggtcagcctgggcaacaacagtgagatcctgtttctacaaaaaattgtttaaaaattagctgggtatggtggctcgtgcctatagtctcagctaactgggaggctgaggtgggaagatcacttcagcccaggaggttgaagctgcagtaagctatgatcgcatcactgcactcccgagtgggagacagagtgagaccctgtctcaaaaatatatctattatttttatgccatataaaaaatatacatatggtataaaattcccttcaaggtctgtgtataaggtgtatatgaaacagaaatgagtttcatgttgagacttgggtcccatccccaagatatctcatatgtacatgaaaatattccaaaatccaaaaaagaaatctgaaacatgaaacacttgtgggccgtagcattttggattagggacactcaacctgtactctatatccttaatgagccggaatacgtctcaatcaaaattgttttccaaagtctgattccaagaaagaagtcactgttgatgaagatgggtgggacttaatcaaaaatgcaacttccagagtgcatcttggggccattacatagaaatcacccttaaagtacagcagagggcttgttagcccagctgaacgctggtcccagggtaatgcaggatccctgtccaaggaagattcaattaggcccagtacgcctaactcactgcaggagggaggacgactgaacttttttttttagagtgttgcaacaaggcagtatctaagacaaggcagtatctaagagtcttttgatgaaactcggaagccagaaaattaactttaattccacaatccaccccccaaggtttaactgtgttttaaaacctaaaactgtgtctttgtcatgtgaaagatggatctgactaaaaactaaacaagtaagaaaaaatataaataaaatattccaaattgtatttaacaagaattatcatttgatgaacaggaagtcaacagtctcctgcaatttctgttcaccctcctgtgaatgggccaccctcgacctggcagactaggatctggtttgtgtctgtgggtgtgaaaccagttggtttgggggctctgaatgggcatcagttgccaacatgcctaacagatataatggcctttgagccatggactctttacttggccattgacaccaacacgtggatctgtttattgcagagctgctcacagagcacaattgacatttggttccagataattctgtgtgtgtgtgtgtgtgtgtgtgtgtgtgtgtgtgtgtgttttgggacagagtctcactctgttgcccaggctggagtgcagtggtgcaatctcagctcactgaaacctctgcctcccaggatcaagcgattctcctgcctcagcctcccgagtagctgggattacaggcatgcaccaccacatctggctaatttttgtatttttagtagagacggagtttcgccatgttggctaggctggtcttgaacccctggcctcaccagataattctttattgctgggggctgtcttgggcattgcagggtgtctagcagcatccctggccctgacccactagatgccaggagaaccctcccccttcacccccacaagtgacaaccaaaaatatctccagatattgccaaatgttcccagaggggcagtgggaataacatcgctcctcagggagaacccttggatttagaaatagggatgtggcccatgcctgtccaggcctcatcttcaaactcagccaacctacccagggacccactccaactgcccaggaaaagcaagtcatggctaggcgatggctcatgcctgtaatcccagcattttgggaggccaagacaggaggatcactcactttgggagtcttgagctcaggagtttgagaccaggctgggcaacatagggagaccctgtctctacaagaaatttttttaaaaaatagctgagcatggcggtgtacacctgtggtccaagctgctggtgggaagctgaggtgggaggagtgcttgagtccgggaggttgaggctgcaatgaatggtgatcacgccactgcactccagcctgggtgacaaagcaagacattgtctcaaaaaaaaaaaaaaaaaagccagccataacggttgcaccacacaatcatgcatccatttgccattccccactaccaggtttctcggatccctgcctctaactctgatcctcagggttgggacttcttcacaagactggttggagcacgcactcagttttcttctagttcctctcctgtggagtctccaaagggaggatattctccagcaaatagcccaggaactcagaaccttgccaacaagccccttccacccacaatcaaggcaaaagaattcaatgaccaccgtggagtctttcttcccttatcctaaggaggacatagcaaaggaatctgcaagttggccaacggacccaccaaatttcgcttctcattctgtcatcattgccttgagcaactctctttatttcagctaagaaataaacaataaaggctgggcgtggtggctcacgcctgtaatcccagcactttgggaggccaaggtgggcagatcacctgaggtcaggagttcgagaccaatctggccagtatggtgaaaccccatctctactaaaaatacaaaaattagccaggcatgatggcaggcgcctgtaatcccagctactcgggaggctgaggcaggagaatcgcttgaacccaggaggcagagtttgcagtgagccgagatcacgccactgcactccaacctgggtgacaaagcaagactctgtctcaaaaaataataagaagaaaaacaaaaaagaaatagacaataaagcgttcatgcttatcatcagaacccagtaaccaataagtgtttgatatggtttggatatttgtccctgcccaaatctcatgttaaagtgtaatccccaatgctggaggtgggtcctggtgggaggtgtttggatcatagctgaggatccctcatgtcttggtgctgtcctttcaagagttctggcgagatctcgttgttgtgaagtgtggcccttcccccaactctttctcttgctgttgctcctgctcctgccctgtgagacccctcctcccccttcaccttctgccatgattggaagctccctgaggcctccctagaagtagacgttgacgctgtgcttcctgtacatctcgcagaaccgtgagccaatgaaacctcttttcttataaattacccagtctcaggtatttcttatagcaatgcaacaatggcctaatacagtatttattcaaagagaagcaggaggctgggtgtggtggcttgtgcctgtaatcccagcactttgggaggctgaggcgggggggcggggggagtacaaccccagcctggacaacacagcaagaccccatttctttaaaacattaaataaatttaaaaataaaaaaaattagctgcgcatgatggcatgtacctgtagtcctagccccttgggaagttgaggcaggagaatcgcttgagcccaggaggttgaggctgcagtgagctatgatggtgccgctgcactccagcctgggtgacagtgagaccctgtctctaacacaaattaaaaattaagaattaaaaaaaaataaaaacaaaaagaagcagggccagtgaggacctgtggtcagagaagtttccagagaagagaggagacctgagagtgactttgaagtataagcagcacacaagtcctcagatgtttcagagaatatgaaagcagtgaaattcctggctcaagaggcttctaatctcgtatcaagctggctgttggctgatgccagtcagagaaattaaaactcctccagttaccaatccaccctcctccttgccagctggattccccagacacgcctgatttctgccttcttcccgctatcatttattcagcaagcacttaccgagcttctgctttctgccagagcccgagcttggcacagggagtataagcctgaaccaaaatgatgggctcctggaagccctgcagcttgcggcctggagggaggacaggcccacagaagtcacacggacgcgatccagggagagagaggaacggcgggaaggcggcctatgcacattgtgtggtttgggaagttgcctctctaagaggaaggaatattaaagctggaacgtgaaggatgaaaggaaatctgccaagcatagcaagaggggaaggacatgctcaagagatggaaatcacacgcaaaggccctgaggcagggaggagctgaggccacgggaagaactcaaagaaactcagggtggctgagatttagagaacaaagagaaagcatagcatgaatttgaagagctaggaagggccgagatggtgtgaggacttctcagccctggagagggggttgggtttgtgctaagtgcactgagaagtcataaattttgtttgtttgagacagggtctcgctctgtcacccaggttgaagtgcagtggcgcgatcatagctaactgcagcctcaaacacctgggctcaagtgatcctcctgcctcagcttcccaagtagctgagactacaggtgcacgccaccatgcccagctaatttttaaattttttgtagagatggagcctcagtatattgcccaggctggtcttgacctcctggcttcaagcaatcctcctgcctcagcctcccaaagtgctgggattacaggtgttagccaccaggctgggcctaagacttttaccttcaaagaaagtaaaatgcaggttccagggatttgggtgtgaacatatcttttgaggggcctccatttaacccagtacactgacacatagtggggtcattattgtgtgttcctgtcctggctcctgcctagactgtgggttcatggtgaacagggaccttcagtgatatgacggggtaatcaatgggcccaggataaccactgtctaattggggtacaggggccggttggactctcttttccatccagaagctctgaccttacaaaattaatatggaaatagcccccacacatccagattgctcaggacattggggtcaggtgaatatgtcaagtaggggccacccagatgtcgaacgccttgataagcacctaccctgttactactgctttctcctgggtatcccttaaattaaaaacactgttctcagccgggcgcaatggctcacgactgtaatctcagcgctttaggaggccaaagcaggcggatcacttgaggtcaggagtttgagaccagcctggtcaacatagtgaaacccagtctctactaaaaatacaaaaattagccgggcgtgctggcatgcacttgtaatcccagctacttgggagactgaggcaggagaatcacttgaacctgggaggcagaggttgcagtgagccgagatcatgccactgcactccagccagggcgacagagcgagactccatctaaaaaaaaaaaaaaaaagacgctgttctcaatgactcttttcaaagaatgattccactccatttcaattatgagtttttgaattctgaaacaattgcaaactcactgaaatgttgctagtagggcacaaataacttatttctgaaccttttgagatgaagttgctgactctgtcagttgcaaatacctgagtgtgtatttcccgcaaataaaggtatcctcctacataacctcactacaaccaccagaaagggaggccttcactctgaaagatgactaccgcctaaccctcaggctccattccaggttcgtcaagtccctagagcatcatttacagctacagggcccagttcagcaccacaaactgtcattgttatgtcttttgtttgtttatttagagacagagtctcactctgttgcccaggctggagtgcactggtgtgatctcgagtcactgcagcctccgcctcccaggttcaagcaattcttatgcctcagcctcccgagcacctgggactacaggtgcccaccaccatgcccggctaatttttgtatttttagtagagatggggttccacggtgttggccaggctggtctcaaactcctgacctcaggtgatctgcccacctcggcctcccaaagtactgggattacaggcatgagccaccatgcccagcctgttatcatgtcttctcagtatcttcccatcttgaacattccctgtctttccctgacttgcttaaccttggcacttagaaaaataaattgtgaccaggcttggtggctcacgcctgtaatcccagcactgtaggaggccaaggcaggaggattgcttgaggccaggagttcaagaccagcctgggaaacataacaagaccccatctctacaaaattaaaaattaaaagtaattagctgggcatggtggcatacacctgtagtcccagctacttgggaggctgagacaggaggatcacttgagctcagaaattaaggttacagtggactaggatgcattgctgcactgcagccttggccacagagaaagatcttgtgtctgaaaaaaaagaaaagaaaaaaacctgtggtaaagcatatatcccataacgtttaccattttaaaacttttaagtgtaccattcagcgacatcaagtacattcatattatcatgcaaccatcaccaccatctacctccagaacattttcatcttcctaaactcaaaattcggacccacaaaactcttcattctcctgtcccccagcccctggcaaccatcgttcttctttctgtctctacggatttgacttctctgggtacctcttagaagtgaaaccttacagtatttgtttttttttttgtgactggtttctttcacttagcataatatcttcaaggttcatccatgttgcagcctgtgtcagaatttccttcctttctaaggtcgaatcatattgcattgtctggatggactacatttggttcatacatccatctgtccacaggcacttgggctggctcacctttcatctattgtaaataatgctcttaggaacatggatgttatcaaccctgatacttttgaagaagacaggccagacatttccctcatccagcgtttgtctgatgtttccttgcgattacattcacattatgcatcttcccaaggacatcactgaagtgatgctgtattcttctcatcgcaggtgacacacaattcagtttgccccagacctgaaaagtgtggggcactttgatccctgcttcagatggagcctgccaggattctccacagcaaagttattccatttccctttgaaatcattataaatttcctgcagaggtcgtttgaaactgtgtaaagatctcctgcctcatcataccactgttttgtaaagcacccccagtcagcagtgatgcgatcctttgagggttgctcagtacagtgtgctggctgattcctcagagctccaaaaggtctggaaaggtctggaaaggatccatggcctccttttcttttcctgaactcggctccggatcagagcagagatgcccttgaagggaatgctgtcattccggagccactggcccaagggcttttgaagacaaaatctgagtaactagagttccctgaaaaacaggaagggaagtacaaccacacaccaagtttcttttagggcattcatacagacttggccaggatggcacaactctgttacatccacccccttgtttggagaaatggatggtgataagcagagtcctctaggatgctatccaccatccatgccaacagcttcagggaggaacatagcatcttcatgagcctctccctgcagccatatttgcttatgaaggaaatcaaaatatttcaccccaaaatatgactccttggtacaatgagtattttgaattaaaaacccttagagatcaacaccggaagagacttttcccctatctacataaggataagactgacccaccaaggagaacaattattcttgttcccctccctgttacctcgttatccattacaggaaagaagacctagacataactacacctgaacagatcctttttccagatgatgactgtctccaaggatcacttacattctaaagagaactatttacaagttaatttctgttccctagtaatcatgtactgtccctcaatagaattcctcttctcccactcccataactggttttagcagaacccaagccccattctttctataacctcaggatagcgcataagcttctggagttccctggaaagttggaccatcattctgaaggcaccgtgtatacacattaaatacatttgtacgccttttctcctatgaatccatctgcctcatgtctatgattttcagcaaatctttctagggccaagagctcctgcaagactcatccacgcggtatggaggtcttactccgaagcatagtatttgtcctcatgcattcaaagacctcatgtcaaagattctaagctagtataatgcttcacaagaagtgaatgtggtagatatagacaggtagacaagtaggtaggtagacagatattcctctacaaacacaagatgattcattttgttgagaatcataagaaaaaaatattttcctacaaaataatcagttgcttacagtatacattcaaaaaatctgtggctgggtacctgagattacagactcagtattgtaatcccaacacttttcaagcccgaggcaggtggatcacttgagcccaggagctcaagaccagcctgggcagcatagcaagaacccatctttacaaaaaaataaaaacaaaaatagacaagtgtggtagcacatgcctatagtccagctactcggaaggctgaggtaggagaatctcttgagcccaggaggtcaaggctgcagtgagccatgatcatgccactgtactccagcctaggcaacagagcaagaacgtgtctaaagaaaaaaaaaaaaaaaatccttgtgtgcttattcattgcatcaccccttggaacagaagacccattcagtcagagatcttgtctgacagttaataattgtgttttctgcacctagaagagtgtctgaaatatcattgataataaatatttattgaatgaaataatttacttctcaaaaacattacatcaatcaatattaattaagcatgttttgcaagttcagtggtggtttaagcagactgaactaatggctcaatcaaggattccttgataaagggatagctctccagtgacaaggaggccatcaggttcatattcaaggttgtggtcagcagaattctaagatggtccccaacattccttatccctggatttcaaacaccttctccaagttattcaatcaaacacccatcgaggggctccagtgaaggggattttgcagatgtaattacgtctcagattaactgcctttaggaaaggggtatcgacctcagtgggtctgagctaatcaccagagccttgaaaggggagagagttttcctggaacgagattggaagcatgagagggctattctccgccattggctttgaagatgaagggagtcctgtggcctctgggagctgaaaaaccccagctgacagccagccaggaaacagggccttcagccctataactgcaaggaactgaattctaccccagccacctgagcttggaaaagaacccgacctccagatgagaacacaggcagccgccacagcgctgtcaacagcttgactgtagcctggtgagaccctgagcagagagcttggccacaccgtacctggacttctggcccgtagaactgtgagctaatacgtgggtgttgttttaagccaatgcatttgtgataatttgtgatgtggcaatagaaaaactaatacagagttcaaaacaacacagtaattcaataagtggaccacagagttcactctcatattaatggaaaaaggttttggatcacatctaaccaagtgccttagaaatgcattcagcctcacacttagtgtggtattattttctcagtctcccaccaagcagaaggaacatttatccctcagctatcagccagaaatttttgttatgttaatgacggtaagagcaacgccaccaggaaagtgagagatttatgtaagacaaagaccaaaaagagggagaaagcgggcagatagaaatgaccaggacagagtggagaaaggagactagggtgcagtgctgggcaaactggagagaggctagggggtgggaaagaagagactttgggggcattaaccatttgtatgtgacaataagaaagagatttgggaggccagggcaagaggatcactggaggccaggagttcgagaccagctcaggccacataaagagacactatctctacaaaattaaaaacattagccgggggtggtggcacacacctgtagtcccagctactcaggagactgaggcaagaggatcgcttgagcccaggaggtcgaggctgcagggagctatgatcgcactgctgcactccagcctgggtgacagagcagtaccctgtctccaaaaaaagacagagagagaaggaagaaagagattttaacaagtcccaccacagtgaactatgaatgaagccccagtttgggcattctcagtgcagtacagattcaagtcacctgaagtgattttttggatgccagactgatgtgttcttttaaagtgatctcacagggaaaaggcactgcctgtggtcacgaaaggtgcacctttacacaggcccgaccagcattcccagactccactgggggaagctgaaaactggttcagttttcccatccttctctttttttcttggttcttccttgctccctccttgaggactcagatctgggaaaatttcctgaagatccatatacacaagacgacattaaaaatgcctgactccttctagcttctagtgctgtatgggggctcacaccttccctgggagcatagaggagaatggagaactggggactctaagagaggcagatatattcacacttttgtgtaaagctttgtggctgaaatgactacttgccccagttcttccagcctctttctttcatagcagtaatggtgaatagggggtgattataccccccagggaacattcagcaatgtctggagatgtttttagctgtcatccctggaggaggagggttgctatcagcatctggtgacttgacgcctagtatgctgcgaaacccacaatgcctaggacagccccatagcaaagaatgatggaaccccaaatgtcaatagtgttgcggtggagaaatcctgctgtgccgccctctgtgggcaaggaccgcagaccaaaggctccgaaagaaactgagggaagccaaatgcatcagctcccatgggcgggttcttatgttttgtacatttgatgctttttctgggaaaagaaaaaaaataattatttctcagggtagaaaagattacggaaatgaaaaccacataatgacagagttatcttgtttagctggccaacaagaagccgtacagcaacagaaagctgccagctggtctgggaagccttagtaaggctgccaggtggtgagatgagtctcaatgactctgcccgggggtctgcacatctcactggcctggttgggcttgcaggaggcccggatggctacgcccttctgagaggtggggtgtgtgggcttaggccccagaactgggcaccaaagagaacgccgtgagctctccttctaggaggttctacgagaaggagggatgtcatcagtggggacatgagggagaagggctgccagaagacagaggacgcataggcccaccatgaatgaggttccagccaaaacctgtctacctaagtggcttcaaagcccctgagatgctggggagaggaaccgagggatttattttcgggggtgctcttgagccgatgggtgagcctctcactgtctcagcacccacagcaggggcgagtttcagaacaagggaaagctgagggttctctccatccctaagccaggaaatcatgccctgtggagtctcaagaggggatgtgggctcctaagacacacacagagacaccccaagagatgcaggagatgcatagccacacggagtcagagagattcagtgggagaggatggccggggtctctttccaggtgagaaacaggaaatgaaagcaactaccataatcagagaaaacaaccttcatggcacaaaaaagaaattccctctatgagtattgaactgttctgcactttccttgttctctgctttctttatgagtgcatacatctgaaatttccatatgacaggactgatatgagcatataaagaggcagataaagagtcattaatttcatcttgtctattccttctgttgtgacagaagcaaccaacctttcgacagatccccagaaactgaaggctcccaaggcactcattccttccgcgtttgcatgccccagtgcttgtagccacagttcctttcttggcaggcgtttgcgtagcttactaatgctctgaatgcaacagcacttcttaaaggccaaaataagtctcttctatttcttaatgtttgttcaatacccataattttatactaatcctacaataggagcaaatttatttccagaaatgtattacaaccattcacagatgattttgagctctcatatgcccttctattttttattttattttttattttaagatggagtctctctctgtcgcccaggctggagtatagtggtgcaatctcagttcactgcaacctccgcctcccaggttcaagcaattcccatgcctcagcctcccgaggagctgggattacaggcacgtgccaccatgcccggcaaattttttgtattttagtggagacagggtttccccatgttgcctaagttggtctcgaactcctgagctcaggcgatccacccacctcagattcccaaagtgctaggattacaggcgtgagccactgcacccagcctctttttaataaaattcaatgaaacgtaatatttcctgtgttcctgctgtgccaagcttggtgctgggttatggaagttggggtcaggcataaagatgaaccaaacaaacacgtgccctggaagaactttttaaatttgtttttctctctgcttcattcattcattaaatgaaatcaatgaatttttttcattaagcaaataaggctgggcatggtggctcacatctataatcccagtgctttgggaggccaaggtgggaggatcacttgaagccaggagtttgagacgagcctgggcaacatagtaaggcccccatctctacaaaaataaaaataaaataagaaaattaggccaggcatggtggctcacgcctgtaatcccagcactttgggaggctgaggtgggcagatcacctgaggtcaagagttcaagaccagcctggccaacatggtgaaacccacctctattaaaaatacaaaaattaggctggaggcggtggctcacacgtgtaaccccaacactttgggaggccgaggcaggcggatcacctgaggtcaggagttcaagaccagcctggccaacatggtgaaaccccatctttactaaaaatacgaaaattagctgggtgtggtggtgggcacctgtagtctcagctactcgggaggctgctgcatgagaatcacttgaacctgagaggcagaggttgcagtgagccgagatcacaccactgcactccagcctgggagacagagcaagactctgtctcaaaaagaaagaaagaaaagaaagaaagaaagaaagaaagaaagaaagaaagaaagaaagaaagaaagaaagaaagaaagaaagaaagaaaagaaaaggaaaattagctgggcatggtggcacatgcctgtggtcctagctactcaggaagctgacgttggagaattgcttgagcccaggagtttgaggctgcagtaaacggtgatccagccaccgcactccagcctaggtgacagagtgagacctgtctcaaaaaaataaataaataaactacactgagtgcctactatgatctgaaacggtagtcaaccccatgcagaagacaaaaacagttgagaaaataggagaggaaacacacgacaaaaccatcagcacccagaattcatcctatcggctctatctgcttgttagggaagggccctatatttggcctcaagcttcccaacagcctatgtaaaaagggaatcatgatcacctatgtgtccacaatattaaaaaaaaaaaaaaaacagagcaagcacttgagaacaaattctgctcttcgtcctgacagaatgttctctgctttttctctaacatggacgtctccatggtgtggagctaactgtgtagccagaacacaaacaagaaacaaagttcagtacctgtgaatacaaacccgcgggtgcaagggtaatgtgcgcacaaacagataggaaagcagtggaaagaggcctcgggagaccttgcggaaaaggtcctgagcgttgggtgagatttccaaggagagaaaaaagaacgacgctccaagcagagggcacagcctggaaaagacatgcagttagaaggaaacaaaacatcttttgatacaggcacgttgctggggtggctggagtgtaggtctcatgggagcaagtaaaggaagataggttggaaaaggcagattggaaaatttcctgaaggcaggctgaggaggtgaggcgttatttcatgagctatgttctggatcaagcagggaggcatgggaggtttatgatggaagcagggaaccctggggttgaggttatggggagaggaggaggtggaagaccagacctatggctggggagtagtagtctacagatgccaagacgaagggggtggcaggcggaggaaacgaggagtatgcatgaagagctctggagagggggcactgacaagctttggaaaaatgactcaatccctggcatggggcctcagcttcgaacataggtgctggagaagtttgcgggatgaggaattacgtgttgaagataggggagaggtatgacagaaaaaaaaaaggctttgtactttagaacctgagcggccaggaggagcccagtgcattaaccagaatagggaagacagatgcagaatccgtcagacgcattgagtccgaaacgtttttaccacatgctgttggggtccagattggtggctgcctgaagggcgttgactgcgaagggacagaagaggtgatggaaatgtctcacatcttgacttggatggtgggcagacaaatatgtaatatgtacctttgtccaaacgcacccaagggcacacctaagagctatgcattttattgcacataaattatatacttccttaagttgggattttttttaaaggaagattctagcagacaaaagtaaagagatgttggcctgccctaaaggagttcacacaagcaaataaatacaaaggaacccaacaagaagtgggaatataaggtgcagaataaacaaggcggggctgagtcctggttggggtttggagaaagcttctcacaggcagtgatacttgaaatggaccttgaagaataaatatattggaaacaaaactgccaaaaaaagcaggaactctaattttcagatgactcattgcattaaaagttcaaacacatccattgcaatgcattttaatgtattatacaaatatacacaagtatatttctatgaaagagacagcatccggctgtatggaagaatttgggctttggaacgggacaattcttggagattttaaaaaattttaacagtaacttcttttgttgttaatattattattatgagacagggtctgcgtctgttgtccaggctggagcgcagtggcacgatcttggctcactgcaacctccacctcttgagctcaagccaccctcccacctcagcctcctcagtagttgggactacaggcatgcgccaccatgcctgggtaatttttatagagatggggtttctccatgttgcccaggctggtctcaaattcctgggctcaagtgatcaacctgcctcagcctctcaacgtgctgggattataggcgtgtgccatggcacgcggccagttcttggggattgttattggttatgttgcaatgggcaagttctgtgatctttcttgtgagtacatacagtaatatctgtattatctggtaatatccatattatctggtatttgtgagaattaggtgagtcaatgaacgtgaagttgttagttcatgataagtgtccctaagtgtaaactcatgattttattacacaacaagagtgtatgtttagtattaaaatgactgctaaaataacacactaaatgatacccacacagagatatgcttttttcaaatatttcaggtgtgaatgttttaaggttggttttctcagctgtgaacccctgggaaactcctgaatttcatttaggaccctccatagtgtcttacattaaatctaaatgtattaaacatttatcatggcaatgtgtatctaaaacagaaaacattctaaccatgtgtgtggagtgcgtgtgtacatcacgtgtgctgtgggttttttcccctcttctgttaaaagaacacacatagagatcgtatgtcctcactgattctgcgggaggaacattgcatattcgagagaaatcctgttcccctctctgggtcttgagggcaagaaaaatcacagacatgagaatctgttggtttaaaccatttcttccaaaaatgattaagcccctgataagtctcaccaatagcgtggccaagactgatttttccccaacctgatctcttgaatcaaggaagccatcttccactctgtccctggaccacttagcaactccagcatccaaatgatacttccaggggaactttcatcctgcatctattatatgtctagtgagctgtgcctgacccagcttatcagaacaatcactgggaaatagaagtaaatggtgagagagtgatccaagtgatgaatgcttcttaaaatgatgatatatttagaatagccaggcccagcctggtggctcaggcctataatcccagcattttgggaggccgatgtgggaggatcgcttgaggccaggagttcaagaccagcccaggcaacatagtgagaccttgtctctacataatacatatagaatagtccacctccccagcttccagaatccttgggaagactgtgaggttcccacattcattgtgggcaggtattggtttactctattaaaaattattttgaaagctgatgggttgttcttatctttctcttgttatgtgggtgtgggggcagagaaggtggtatcttcttgtttctatattgtctattaatggttgtaatggcaagaaccgtctggtaagtggaaattgcaaatgtgtccaagagctagtgaggggagagatgtacctcggtaaagcaaaggtcaaattcaaatggaagatgaaacctgaaaatcttatttgaggcaacataaataaatggaatcagaactatttctgagtctgggaagtacgctctgcagagaggaaaagtatatgtcagactttaactatttatccctacatactgggaggccgtctgtagaaggaagtattatagtaggaagtcatgatgttttctaccagagacatcctcaaagtgttgctgcaattctctaactgtattagtccattcgcacattgctgtaaagaaatacccgagcctgggtaatttataagaaaagatgtttcattggcttcacagttctacagctgtagaagacacatagtggcatctgcttctagggaggcctcagggaacttccaatcatggtggaaggcaaaggaggagcaggcacgtcacatggcagaagcaggagcaagagagagagagataggggaggtgctacacacttttaaatgaccagatcgcacgagaactcactcctattgcgaggacagtaccaagagggatggagctaagccattcatgagaaatctgcccccatgatccaatcacctcccaccaggccccacctccaacattgaggattacattccaatgtgagatttgggcggggacacacatccaaactatatcactaaacttgggtttgaaactttcagcctcttaagctggagataacctttcaatattccttatctatttcagatctaccatgcacggactacccagcactcatcattcacctcctcttaccacctcctcggtcttcatcctcactcatgcagcagtgtagtacaggactccactgggttagagggcagcccattgcagtgcaagctcaagctctactatttagtactgcatgccatctccagtactaaagaaaggctgtgtattcattattagttgctgcacgataaatcattctgaaatttagtggcttttcttgaactattattttaggtttaggggtacatgtgcaggttggttatataggtaaactcatgtcacgggagtttattgtacagtttatttcatcacccaagtactaagcctagtacccgatagttattttttctgctcctctccctcctcccaccccccaccctcaggtagaccccagtgtctgttggtcccttctttatgttcatgagttctcatcatttagctccctcttataagtgagaacatgcagtacttggttttatgttcctgcattagtctgctaaggataatggcctccagctccatccacgttcctgcaaaagacatgatctcattccttttttatggctgcatagtattccatggtgtacatgtacgacattttctttatccaacctgttactgatggacatttagattgattccacgtctttgctattgtgaataatgctgcagtgaacattcacatgcatgtgtccttatggtagaatgattcatattcctgagtatatacccagtaatgggattgctgggtggaatggtagttctgtttttagttctttgaggaatcgccatactgctttccacaatggttgaactaatttacattcccaccaacagtgtatacgtgttcccttttctccacaacctcgccagcatctgttattttttgactttgtagtaatagccattttgactggtatgagatggtatctccttgtggtttcgatttgcatttctctaatgatcagtgatactgaacttttttttatatgctttttggtcacatgtatgtcttcttttgaaaagtgtctatgtcctttgcacactgtttaatggggttgtttttctcttgtaaatatgtttaagttccttaatacatgctggatattagacctttgtcagatgcatggtttgcaaatattttctcccattctgtaggttgtctgtttattctgttgatagtttcttttgctgtgcagaagctcttataattatatcccatttgtcaatgtttacttttgttgccatgcttttggcatctttgtcaataaatttttgcccgaatttaccaaattaagtggcttaaaacaaccataatcatgtattccatctcacatttctttgggtcaggaatccaggcagagcacagaatggatgacattcttgattaatgatatctggcacttcaactggcagactaaatggggactggaagcatctgaagacgatgtgctggaggatccagggctggtaagctggtattggctgttggagggaggcctctgttcctgtgggcccctccgtaggactgcttgggcatcctcacaacatgctgtctggttctcccagatgagtgatacaagacaccaaaaaggaacctgaaatgcctgtgatggcctcagaagtcacccaccatcatgtccttaatattctattggtcacaaaggtcaaccatattcaacatgggaggagactatgcaagagtgttgtcttagtctgctcaggctgccataacaaaataccataaaactggatggcttatagctcaccgtgctgggggctgggaagtccaagatcaagatgtcagccaattcatttcctggtgagggctctcctcctggtttgcagagggctaccttcttacagaattctcacatgacacagagataaaggagagagggctgctctcttcttcttctcataagagcattaatcctgtcagagggctctacccttatgaactcatctatcctttattatttcccaaagcctcaccttcaaataccatcacattatggattaggggttcaacatatgaatgtaaggggcaatcaagcttttagtccacagcggatgtgaatacaggaggtgaggatcattggagactatcttgaacacttgctaccacaggcaacaaaacacagcaaagagtcttttggcatagtggtatggcatggcaggtatagtacagtatactacagtacagcgtagtactgtgtaacgtacactgtcaaaccacatcatttgggttcacatccaagccactcatttactctgcagcctaaagcaaattgctcaatccttttgtgtgccccagtttcaacatatttaaaatgtagtagattagatcattgttaggcaagtactcattcctgacaccacttcctcccaaccttcgtggaaggagtatacttacccactccatccgtgttggcttgacactataagttgcttcgaactcatgctgggcagagtgtacatccccatctctttatttgaggctcagcaatgtgcctcactatggccaatatgagaagatgagacacaagtggaagcttgaaacgaattgtgcagttttgctttccctcttgaacgtctcccatgactatgggaaagaaacagctgcagtttgcctgctagtttaaggagaaagatgcctggagcaaacctgaatccagtgtgcagcttggagctatgtgcagataagctcagactaaatcttgctggctctcagccaagctgtggccacattggggagattaaatgattgctgtgttcagccatagaaattgtttggggatgcttcttatatggcattattgaggtgctagctgactgacagagatatcaatgatagaacctatttcatagggttgtgaggattgcatgagataatgtatgtagcacatttaaagcactgtctggtgctggagcttgttcacagagcctttgaacttcctctcggaatatgcagttgcccctccagcctcctctgcagggctgctttccctggcccacgcactccacaatgttccagacttccttgtccttcactgtactcagcttcatcctctcatgcctttccacacctttccaggtgttaagtagctgatctaattcatccatgttagcacaatagtgggaaaatgctacctccaccttaccgcctccgcccttcctggaaacaagtggtttgttatttttgtttgttttaaacatttattggagtcaaaggctccttttgtctcatcctggggaatgagtcatgatgaacaactcagacaagggatgaggggatgggcaggctgttacaagctgggtagcagaggaaggcttctgtgaacgggagaacaatttctctgaaaaaccaggtagagctttgaggcaacccagaccttcagagcatgcagggctcattcaaatcacccacagcccagctctccacctgtgctcagggccaaccccgtcactccccgcgcatgcaggtggccattgttgagagcactaactgataccccaaacctcacccgaggagccacaggaaaactcttataaaggggtcaagggaatggaagatgctgcactggcctgagctacaggaacctccaacctcgtgaccagaggaggcagcaggggtgggacccctcaggtatggcttgcatggagaccagccaggacaggatttctcacccttggcactgcagacactgggggccagcttactatttgctgtgagggctgtcctgcgcatgtaggatgttaagcagcatccttgactccatcctctatatgccagtagtacctcccctactccccacagctgtgacaatcagcgatgtctacagatattgtcgagtattctctgagggacgagggtcaaaataccctcagttgagaaccgctgagctagaggcatggagccagaactgagatcacaactattctgtcaacaaacacttcctaagcacctatcatttgctaagccctgtgctagaatctgagagtacagggatactaagggggaaagacctgtaaataatgaatagtaatatcacgtggttactctcccataatcaagtgggaggcaggcaaggattcaatctgcttgggacagaaagagtcaggaaccacagccagagtgggcacagacgccctaacatgcttcccttcacaccttcctctggcagcactgcacactggggaatgcctgctccctcctcctcctctacagcaatttatgcataatcagagcccctcacttcagaagatcccagatatacggtcaagtaatcctgtgtggggcatgagatctgtgcaccagtttttgaatcactgctggaagtgctcctcccgctctaggatttcaggtctacttgtcctctttgcccctacatctctccgatgcctttaaaaacatgactttggggccagtcacagtggctcacacctgtaatcccagcgctttgggaggcctaggtgggcagatcacctgaggtcaggagttcaagaccagcctggccaacatgatgaaatcccatctctaataaaaatacaaaaaaaagaaagaaagaaagaaaaaagaaagaaagaaaattagccacgtgtggcagtgggtgcctgcaatcccagctactcaggaggctgaggcaggaagatcccttgaacccgggagtgggaggttacagtgagccgagatcacactactgcactccagcctgggctacagagtgagttctgtctcaaaaaaataaaataaaaataaataaaaatacaaacatgactttgtctaatttgtccattttgttctagttgtagaagcagcagcctgcccctaacccaaagcagaaatcaatgttttttccatctccccggctgcctctcacaggcaaccagtgctgggaagctctgttgaaggaaatgcgtgggccaggggctctccaaatgtggctcccagccagcaagtcagcctcactacaaacttgttagaaatgcacattcctagatctattgaatgagaagcactaaaggctttcaggtgattgtggcgcatgttcaagtttttcattggcagtctggtgcggtggttcatgcctgtaatcccaacactttgggaggctgaggcaggtgggtcacaaggtcaagagatcgagacaatcctggccaaagtggtgaaaccccgtctctactaaaaatacaaaattagctgggcgtggtggcgtgcgcctgtagtcctagctgctcgggaggctgaggcaggagaatcgctcgcttgaacccaggaggcggaggttgcagtgagctggagatctcaccactgcactccagcctggtgacagggcaagagtccgtctcaaaaaaaaaaaaaaaagtttttgattggctgctagaggggctgttctctggctctattcagttatcacaggctctgcttacctctgctctaagccccagcctgcctgtgttcaacccactcacccatggctcttgacgggtcttgctaagtgggagtgcatgcatccttggaaagctctggcctcccaggtgcggccgcctcactgtgatcttggcccacttccctctcatagcccaggttcaatgtctaggctcccacttggttttctattttgtactcaagttctggacatgggggttgccccacccaggcactcttgatgagaacttccagcattgtctccctgagtctggatgggtcccgaccaaagtccagggccaccaacacccagagatgctcaaactccttggatgctactgaagctggagacatctacacccttgcacacctacatcttgctacttgcctaagcccctgagggagcagtcctggagtctgtctaaatccaatcccctgacacagtgctgggcccaatgccccctcccccaggcagccagatgcctgggcaggaccaaatcattactcaggccaacctgcctccctcttcagccctcccgctcttctgcttaatgcagaattcataaagcagcttcctgtgtattctttagagagcgctctcctgccacccaggaaaaaaaaaaaaaattgagggttgaaggaatttaagccagtagcaaggatggaaaagaaagatacagcaagaggaaaagcagataaaattaagtggggaagaggtcaggccaaaagaaaaaggaggcagagagacaaggggaaaaaactgaatcgccacggtagaaaggaaaggaagagacatgtggagggaattacgcatggattttatttgaaagtgagaggctaggaaagcataaataaatgtatagagattcaggtggaattttgatttctacaaaccttcccactagtcctacaaggagaaaaaagaaaaaaagaatcaagacagaatttaaaccgataaactcgtgtggagattagcgtgttcccgtgggttccaggcatgggaatttgccttgttgagttactcctacaatatttgcctggcttcttaaccctaggaacaaaagaccaaggttttcaaaggggatcctggatgaatcctaatgaggccaattgtattagtctggtgtcctggtcgtaaacaatagtactcaactctagctaatcgaaacagaaaatgaatttattcaggaataattagtagttcacagaatctccaagaggatacatcagacataaaggcaacgaggtcaggaatgatgtggcgacatcacaaaacagctccagcaaagaccagactgaggccaaacctgaaaatgacaccatagcttgaccttgaacaagagagtagggtttgcctagtagacacaagaaaaagaatgtgttttccaggcaagggatggtgttaagatgtatctctgactatccatcctcccctcttgccttagcagtggttctcaacttggtttgattttacccccaggggacataaggcaatgtctgaagacagttttcttgtcataactaggggtggggtgatgctcctggcatctagtgggtggaggtcaaggatgtggctacccaccctgcaaggaaggtgcaagatagtgtcccacagcaaagaagtaacagaacaagaatgtctgtagtgctatggtggagaaaccccactctgcagtaataaaacctgcaatttttagctgagtccctggccacccagaatccagatcacatttcccagcctcatttgcagctatatgcatctatatgagtaagctctcaccactgggatatggacagaaatgatgtgtgcaactcagaggaaagaagcatgccctcctgtcttcatcggttcagctgctcaaattaccgtagactgcgggacttagacaactgacatttatttctccctattctggaggctgggaggtccaaaatcaaggtgtcagcaggtccaatgtctgcggagggctggcttcttggttcatagacagctgtctcctcattgtttccttacttggtggagatgcgagagagaagcagaagctctctggtttctcctcttataagggcactaaacccatcgcgaggtccacaacctcataacctcatcacgtcccaaaggcttcatctcctgacaccatcccattggaggttagagtttcaacatatgaatttgggcatgacgcaagcatgcagtctgtaacagctcccctttctccttttctcctctggatcacaacgttatgattggacacggaacagcggtcttagaccacaagttggacactgccgaaccaagaaagagccaccgagtagaaagagcctggctcatggctgggcgcggtggctcacgcctgtaatcccagcactttgggaggccaaggcgggcggatcaggaggtcaggagatcgagaccatcccggctatcatggtgaaaccccgtctctactaaaaatacaaaaaaataagccgggcgtggtggcgggcgcctgtagtcccagctactcgggaggctgaggcaggagaatgggggtgaacccgggaggcggagcttgcagtgagccgagatcgcgccactgcactccagcctgggcgacagagcgagactccgtctcaaaaaaaaaaaaaacaaaacaaaacaaaagaaaagaaaggaaaagaaaaagaaagagcctggctctctgctgcttgccagaacactgcagcagctctgaacctccgccccaactttaacctgagagagaaatgagcttctgcctggcttatgcaaatttggggcctctgtatcttgcagccaaaatgaatcaatttcactgtatttaggggaacccaagttcacttgcctgacctgagaagaggtcactcggggcaggtgaggaaaaaaggatgaggctgcctgtggaacgggactgaagcagggttgtcttcctgactgccgtggcagaaccttgacctctgaaaggaattgggccccacgccttcagatgtcttcaggtttacagatgtctccaaagcataatgtttttccccttgcaatgcaagactgtatgacttctcaagacttaactgcatttgtgacaagagaaggagcgcaaagtcaagttgcaatagtgatgcccacacatggctggtctcagtcatctgctgagtggctcactgcagcacactgtcccactgtgcccgcaatataactgactgcagcaaaaacaacacttcagctgctcggaacccagggccactcccagattattgattcttcaatcactaaatccataaatgctgtgaatctctgattccaggggtcagcaaactgcagcctggagcccaaaccccagcccactgtctgtttttgtacagctcatgagctatgagttatttttacatttttaaattaaattaaattattattattttttcaggcagtgtctcactctgttgcccaggctgcagtgcagtggtttgatcacggctcactgcagactccacctcctgggctcaagtaatcctcctgcctcagcctcttgagtagctggaactacaggcatgaaccaccatgcccagctaatgtattattatttttttgtagagatgaggtctccctatgttgcccaggctggtctcaaactcctgggctcaagagatcttcctgccttggcctcccaaagtactgggattccaggtgtgagccactgcacctggcctttttttaaagggttaaaaatcagaagaagaatactatttcatgacacaggaaaattttctgaaattcaaatttcagcatctataaataaagttctatgggaatgcaaacatgctggctcatttagttcttgtttctggacagaggccatctggttctcaaaacctaacatatttactacctggtgcttgacagaacaggtctgctgacccctgtcctataccatcaaaacattcacaagtcagagtatctcaattcccaggttgagcgcagttagcatcttccaactcgattaactctctcactaagccatagcacaaatcttgataatgtatccaataaatagggccagctctgtgggccactacagttgcacaggccatgggtacactcaatggacaacttggtggggtgtggcaagggtgagcctttcccccaccctgatccagatacctcacactttttcttgcttttggaacaagaaacctttcttttgtgttttgcactggactctgcagttacacagccaggcttgccaataaatactcattttttcatttgcgattattgaaaggcactccagttttatccctctgtgttattcttcaattggtcatctttgtcctgaaagaaccacaaggaagtatttcttccttagggcttctacgcagaacagtctcgtagtgctgtgtagtaactgatgctattgagtcctgtctgtattatgtcgcccccaaccttgacacaccaaggaacatgcctagctgtgtgcaagacaagccacaaaggctgaaaagttgggctcctagaaacagcactcaacaaatgacccttggcagttggggtataaataccccagctcccttgcccttcaggtgggatgactctgaggcatgttctacattatccccagaagtccccagcagattgggctcctgttgccagcagtggtcacaggcttgggaatccctcttcattggctgtattcccttccctgtctcacttcccaactcccttatgggtgtctcctgggattagctcacacatatactacttgcactcaaatcctgtctctggtctgcttttgggaaaacctaaatctagatagtatcaaactaagaacccagctgaggcataaagaaaacttgcatagattaatattttaaaataatgataattcagcaagacagagtgtgggcatttttgctcattgctgcagaatgtaacagacttttttctcttatggtctaaaaagagggtgcagctttgacaagcacagagaaactctagatggtaaaatagaggcaccaaagtagatataattaaggtgtatttttttcctatttggttcataaatgtaacatgtgaaagctaaatcaattgctctacaaaacagcaatctgacccttctgaaaataatgtctttgtggaaaaaaactgagagaagagaagggaacgggcataggacagcatagcacagtctcgattacctagctaactggatcagagttctcaagcagaaaagattaagtattgatcctcagtgggggcagggagagaaccctctgtgtttctgcttcccttttccctgaatctgcatttttatcctctatatagggggaattttcaactcccctgccatgtccatgacaactttccacctcttacagaataaatgatttttagaaaaaccatcttactgagatcatttgccttgacactgaaaaaaaattaccatggcccccctgcagagaaaatatatctttacataagtgcaaatgaaatgtgaatgtcaggattatcagctgttagcattaaaacttaatgcacatgttcagagttgaaatgacttttacaatctcttgtagtctcgggtggattttttttgaaacatgatttgtgtctattgtaacagatggggaagtcactattatatacattagataaatgataaaaagcaaaatcagctagattttaaaaggtacttcaaaaatgtgcttctcattatgcttttcttctgagtgttcaggcagataattttcatttttaacaaggaagcatatccatttcttgttatgacttcttaaaatataaaattaggcaatggtggttcatttcagccattttaatctttctattcacttttgttaagtaattgtcaaaccctaatccatattcatactaaaaaatatagatttttatactgaagttgagggtgatgttttcagcatcatcagatgtttcctgcaataatgttagttccgggcatgaatttccacagggattttcttttctttttgcatatttgcagaagtgtatcaagctttctctactgttaatcataaattcaaaggaggacaaagcagctaacttttattatgaggagactttccaatcctactttatagaagaagccaagttgaaaagagattcctttttaagacagaaagtatggcgttggagaggagaataaagttaacatcttgatttctgccttttagtcatgcctatttgagattataatgaaatctgcatccctcttgaaaatgaaaaataatccagaaccttgaccctttattgggtgccatagctgttgctaatggcatggtttataactcaatcagcacaaggaagaaagtaactgctaatgcagaactgagctcaggcaaggccagaagagccacctgactgagcccagcccaaattgctgacccacggaattacaagctaaataaaggtgattgttttgcatcataaaattttggaaccatttgtttaaaaagcaagagctgactgatggaaatacttttaaaaattttaattttactgtgtattcaataatggtgctctgaaaattatttctcaactattcaaaaccagtagcatttttaatttaaaaaaatttaatcagctgggtgtggtggctcactcctgtaatcctagcaccttgggaggctgaggtgggtggaccacctgaggtcaggagctcgagaccagcctggccaacatggcaaaaccccgcctctactaaaaatacaaacattagccgggcatggtggcacatgcctgtagtcccagctactcaggaggctgaggcaggagaatcacttgaacccgggaggcagaggttgcagtgagctgagatcgtgccactgcgctccagcctggatgacagagcgagactctgtctcaaaaaataaacataaaaaaataaaaaataaaattaaaaaattgatgtttagtttacctatggtaaaatgcatatgtgtaaatggacatttaggctgggcacagtggctcatgcctgtaatcttagcactttgggaggcaaaggcaggagaattgcttgaacctgagagttcaagaccagcctgggcaatatggtaaaatgttgtctctacaataaataaataaatggacacttggatcagttttgacaatgtgtacacccacgtaacccacacttccaccaaaacagaacatttccatcacccacacagttctcctgtacccttttttagtcaatcctctctctatccagaagcaaccactgatctgccttctgtcactaaacatttttttcccagaatttcatataatcaaattgtgcgtactattttgtgattggcttctttcactcagccagaagctttggaaatctatccctgtgtgtcattgcatgtgtagatagcttattcctttttattgctgagtgatattccactctatggctgatgtcaccgttctcctattggtagactacctggactgcttccagcttttggtgactatgaataaaactgctattaacatgctttcctcaggctgttctagccatatactttaatttctcttaggtaattacccaggggtaaaattttggggcataggattgatgtacgtcaaacttttcaacatacttccagttttccaatgtggttgccctctataaattccttctgcagtgtatgtgaattctggttgttctaccccttggccttccttgggcatggtcaataacatcagccaggccatgcatgtgtactggtatttcactatggtctgaaaaagtccttttaaaggtgtttcttttgcataagggttaagtaacactcatttcaccaaacaataatgattctggataaataactgtcaggataaatgattgtttggatcataattgtcaggcttgtcttgaactcctggcctcaagctatcctcccacctcagcctcccaaagtgctaggattacaggcatgaaccaccgcatccagctgagaatctagttcttaacacaagtatgcatctaaccacatcacatttttaaatagttatgtggcaaacctgtgcatcttatctcagtgcaacatggcttctaagtattccagcacaagactaagcaccactgggacatgtataaataaaaaatagacagaaatggggatgttggggagagggaggaggagtaaagaccagaaaatagatcactgattagtcagtgtacattaatccaggattaaatgtgtgttaagcctctttatcttctactgtcttgctttagtcatggcgtgaaggttgcacctggtaatttagttcattcaaatacttattaagcccttaccttgtgctgtcaattgggaatatgctgaccaacaagacagatactgttcctgccttcatagagattacagtttagtgggagaaacaggacaaataataaggaattccaggacagtgcagtggaggctgtgatcagggcagtgcaaagagggacctatgtgggacattaggggtcagaagaggcttcctagagaaaatccaagagggcgagtggcttacatgaaaaaatatagtgttccgtagggagaacacagcacataagccaagtgagaggatgtggtgtaacaatgcataacaacatttccgtcacataggccagtgttcccataagactataacagcatattttactatatttagctacatttagattcacaaatactcgccgttgtgttgcagttgcctacagtgttcagtacagtcacaggctgtccaggttactagtctaggagcaacaggctagaccagagagcctatgtgtgcagtaggccctaccaactaggtttgtctaagtccactctgtgatgttcacacaatgacaagatcgcccagtgactcatttctcagaacatatcctcatcattaagtgacgcatggctgtattatatcaggagcaaggagtaccatatctgtggtgggcagggctgatcttgaagatcttgtcagatgtgttaaaaacccggacattacccagaggacaatgggaagccactgtttggatttatgaaagaatgtgagtggcatcataaaatggtgcagctgctctggaaaacggtttggcagttccttgatttgttaaacatagaactaccatacgacccagcaattccactcctgggtatgtacccaaaagaactgagcaccagtactcaaacaaatatggatacacaaatgtttgtagcagcactatctacaatagccccaaacgggaaacaacccaaatgtccatcagtaggtgaatagataaacacaatgtggtattacaatggaatattattctggtataaaaggaataaagtactgatatatgctacaatgtggataaacctcaaaaatattatgctaagtaaaagaagccacactggaaaacacattgcaaaactccatttatgtgaactattcagagtcagcaaatccatggagacagaaaagtggattcgtggttgccaggggctgtgggtggagggcaacggggagtgactggttaatggggatggcgttccctttggaggtgatgaaaatattctgtaaatagacaattgatactagcacaacattgggaatgtactaaacgtcactgtcaattagttttctgttgtgtatgttgtaccataatttttaaatgagatttgtgtttttacatcacagggaattaggggctataagactagagtcagaaagtgcagttaagaccatttaattctggggaaaacaatagcagaatagtagttagtggtgggaggaagttcacagttggaagtaacatctagaagctatgacagggcttagttactgggtatggtggtgcgtccctgcagtcccagctacttgggaggctgaagtgggaggatcacttgagcccaggaaatcgaggctgcagtgagccgtgataacgccactgaactccagcctgggcaacagagcgagatcctgtctctagatgaagaaaaagaaatgactttgcttttttcacatctcttttccctctttaaaccagcaagtgtgcatcttactcttgggcagtatagattccactttgtacttaactgtgtatcccaagtgctctggctttctgctgatggagacaggggttgagtccatatggaaaaacttgtatcaaccagtccaaaaagctgggctaccctttgggcaaccctcaccccatgctgacacacactgaacttttccaggtctacacatgtttaggattgtaatttccagtgaaagttacaatttttccatacctttaaaatttatcttgtgggaaacagtcatataaaatcaaccaaagtgccccatgattcactctgtgtcagatcccacggtaagcactttacagcagttagcccacaggacacgctaataagccagtggagaagggagaattcttatgtttgataagctgaggaaaccaaggggttcagatacacccacagcaaataagagccagggtgggagtttgagcgtacttctgactccgaagctcgtattcatcacctccttgttctgctgggtagaagacaggttagacccacctgaattgcaggagctgatttctgcttgatcagatcctaatctcagattttcagaggcccaaagctgacctggtgcggtggctcatgcctgtaattccaaccctttgggaggctgaggtggaaagatcactggagcccaggagttggagaccaacctgaacaacatagtgagaccttgtctctacaaataataaaaattaaaaaatgtggctgggtgcagtggctgatgcctataatcccaacactttgggaggccgaggcaggcggatcacctgaggtcaggagttccagaccagcctggccaacatggtgaaacctcgtctctactaaaaatacaaaaattagctgggcatggtggcacgcgcctgtagtcccagctactcgggaggctgaggcaggagaatcacttgaacccgggaggcagaggttgcagtgagccaagattgtgccactgcactccagcctgggcgacagaacaagactccatctcaaaataaatcaataaataagccaggagtggtggtgtgcctgtagtctcaggaggctactcaggaggctgaggtgggaggatcgctgagcccaggagttcaaagctgcagtgagccacgatcacaccagtgcactccagactgggcaacacagcgaggccctgtctcttaaaaaattaataaaaatttttaaaaagggccagaaccctgtaaggaattatcatcttttgcttatttatttctcttccctcactcctctccttaaggtaaacaagagctgagagaaaagccccattcaacctggaggctccctagagcttcataacgtcccaagtcagggagctgcaaacctgttctgtaaaggaccagagaataaacattttaggctttgctgtccatgcagtctctgttgcaactacccaattttgtcattgtagccgaaagcaaccacagacaatctgttacaagaatggatgtgggtatgtgccaataacattttatttacaaaaataggcagcgagctggatttgacccatgggcagtagctggccaacctcttctaaaccaagggtttgggatcgtgttttgattttttaaaattttattttattttcttagagacaagttctcactctgtcacccaggctagagtgcagtggcacgatcatagctcactgctgccttcagctcctgggttcaagagatttttccacctcagcctcctgagtagctgggactacagacacgcgccaccacacccagctaattttaaaacttttgtagagctgaggtctcactatgttgcccaggctggtcttgaattcccgggctcaagtgatccactcgcctcggccttccaaaatgttgggattacaggcgtgagccaccgtgcatggatggattttattcatcaacggtctgcctggtcctcactaccaacattatcccggagcactgagtggttgctgaggaaatagctgtgggtcggggccaagatcgcaatccctgctttgctccacggcagcgttatgatcacgactgtcctgccattgagtgatcaaatatcaccgaggaaccagcctggttagaggctgctcacttccgttccagacaacagtgtgcagccctgcctccaggcaaaggagaagaaaggaaaaccatccaacaaattaattctttggtcctcagcaattataccagccaggactcgtgaattatttaaaactagaaattaattattcaatgagagttcaccagaagcatttctggccatacagaggaaagcaggccaagctattgccgtggaattcagatgcaataaagcaagtatctgagcttcctaatgctggtcaggcctgggaatgagcctggagagtggggcacactcaaccactgtgtgtttccagagagaaggggggtgaatagaaaagatagaaaattcatcaactatgtgaatgtaaatgccccttgctgtttgcagaccaagactctgagtgatcaagtcttcattgtacgttaggcttttggttttcctctgtaataatggaggctttgagaaaatgcgatttttattttatttacttattttttgggacagggtctcatcctgtcacccagactggaatgcagtggtttgaacacggctcactgcagcctcaacctctgggctcaagcaatcttcctgcctcagcctccggagtagttgggaccaccatgcctggctaattttttcatttttcgtagagacaggtgtcttactttgttgcccaggctggtcttcagctcctggcttcaaccaatcctcccacctcagcctcccagagtgctgggattacaggcattagccaccatgcccagccagaaaatgtaatttttagacaaagctacattaggcactagcttatattaatatggcccgctggacctttttctgagaagctggaaggagcagaaaatgatacccactgcccggtaaacttttttttttttttagacagagacttgctcttgtcgctcaggctggagtgccatggcatggcctcagctcactgcagcctccgcctcccgggttcaagctattctcctgcctcaacccccaagtagctgggattacaggtgcccgccaccacgtgtggctaatttttttgtattttttagtagagacagggtttcactatgttgaccaggctggtctcgaactcctaatctcaggtgatccacctgcctcggcctccagaagtgctgggattacaggcctgagccactacgcccggcccctggtaaagtttttgcagagtgcatctatgaacttattcaatgaatgtctttgatgatttccttaggcatcaatgtttttctaccaaatttttaaaaacttttcattttgaaataattatagactcataggaagttgcaaaaaatgatacagagaagcctcttgtgcccatcacccaacttcctgcaatggtggtatctcataactatagggcatttcaaacccaggaaatcaacaaaggcttaatacaattagtctacagacatcatatggatttcacatcttttcatacactcatgatatgcgtatgtctttgtgtacaattttatgaaatgtcactgcagatatagattcaaataatcccccaccactatcaagacacagaaccaatcccagcactttgggaggctgaagcgagtggatcacttgaggtcaggagtttgagaccagcctggccaacatggtgaaaccccgtctctactaaaaatacaaaaattagctgggcgtggtggcgcgcgcctgtagtcccagctactgaggagactgaggcaggagaatcaattgaacccaggaggcggaggttgcactgacccaagattgcaccactgcactccagcctgggcaacagagcaagactccgtctcaaaaaaaaaaaaaaaaaaaaaaaagacacagaaccattttctaaccacaaaggaagcctcccatgtcaccccttatggccgcatcctccttgtcttttcccaaccccaggcaatcaactatctgttctccatctctataattctgttatttcaaggatgttatataaatggaatcatacaatatatgacctttgaggagactggctttttatactcagtgtaattccctggagattcatccaagttgtgtgtaaaaataaatagtatgtttctttttcatgctgcaaatgtaccaccatttgcccatggaaggacatcagggctggtggcatttttttggctattaaaacttcagctgctatggacattcatgggcaggagttcatgttaacctaagtgttcatttctctactataaatgcccaagtgtgacttctgggtcacagtgctgttttccaggtttccagagaagatgcaactaacttttaacagttttatttttatccccctatttgagttccaaagaaaactatatttgcatatctactatttgggattctgatgagatctatcagtagcctcaaaaatcttggaacaccttggcttaagtgattgaacattaaacaattcacttattctacacagaaatcctgaattagaaataataggtgactggtggaagaaaatgagagagaaagagcgagagagagagagaacttctaagaggtatttgtcaagagtcaaagtccagaaaacaatgtgagctttcatttggcagagctctggtgagcaagaatttcccaagcaggcgtggataaggtgggactggatgcctttatttatgggatttctttgcagagcctgctggaactcagaatcactaatgagaatcaacatttgtatagacagcagtgtttcctgtccaatctctttatgttggcctcagatctgagacttgtggcttgggctgcggcatctgttaagactggccaaagagcgtggctccctccctcccagctcctctctctcatgacccttagtcacatttgtttgggttgtttttctttctgtttttcttagagacagggtccctccttctgctgcccaggctggagtgcagtggtgtgatcatagctcgctgtagcctccaaactcctgggctcaagggatcctccctgcctcagacttctgagtagctgggactacaggtatgcaccatcacaccgataatgcacgccacacacataatttttatatgtattttttgcagagacaggatctcactatgttgcccaggctggtctcaaactcctgggctcaagtgatcctcccaccttggcctcccaaagtgctgggattacaggcgagccactgcacccagccttgcttgggttcttttgacatcaactcttccttcatgatgagtaggggaaaaaaacgcaggtatgccctcaaggttaattttgcactacgttttcattcattgctggttttcattgcctgcagtagaaatttagcaacgatttttacactccagggggaaaacaatgctgagtaagaaagtgtgcttttattttattttattttttttttttgagacggagtctcgctctgtcgcccaggctggagtgcagtggcgcaatctcggctcactgcaagctccgcctcccgggttcacgccattctcctgcctcagcctcccgagtagctgggactacaggcgcctgccaccacgcccggctaatttttgtatttttagtagagatggggtttcaccgtgttagccgggatgctctcgatatcctgacctcatgatccgccctcctcggccccccaaagtgctgggattacaggcgtgagccactgcgcccggccgaaagtgtgcttttaatgacttgcttcttgctagcaagaaatattgtgtcccatgctcctggaggcaggagggagattaacctggtctatgtaattgctgtgtgcatctccccagcaagaagtctggcgaggagcaggacagggcacggcagaaacaacactcaccacattctccatttccccacccgaatgggcagaaacatatcgagggccctgttttcagtgctcaacaggcacaatttcattttttctctcaaatgcagaaaacaagaactctgttttgattatgctgtagccccatgtacaagaaagtcactgttaaggccgggcacggtggttcacacctgcaatcccagcactttgggaggccgaggcaggtggatcacgaggtcaggagttcaagaccggcctggccaagatggtgaaaccccgtctctactgaaaatacaaaagttagctgggcatggtggcgggcgcctgtaatcccagctactcgggaggctgaggcagagaattgcttgaacccaggtggcaaaggttgcagtgagccgagatcacgccactgcattccagcctgggtgacagagcgagactctgtctaaaaaataaaggaaggaaggaaggaaggatggaaagaaggaaggtaggtaggtaggtccgggtgcagtggttcacgcctgtaatcctagccttcgggaggccgaggcgggcggatcacgaggtcaggagatcgagaccatcctggttaacatggtaaaaccctgtctccactaaaaatacaaaaaaattagctgggtgtggtggcgggtgcctgtagtcccagctactcgggaggctgaggcaggagaatggcgtgaacccaggagatgaagcttccagtgagccgagatcacaccactgcactccagcctgggcgacagagtaagactctgcctcaaaaaaaaaaaaaaaaaaaaaaagaaagtcactgttacatagtaggtgttcaataaatatttgtgacatgcattctgcagtcatttgacaacaacaaaaaatataatgatctcacagatctttgttactctgccattcgccttataagtgtggtgaaatggctatgagcacagaacggagggataaaactagctgggtccaaagacatctctaccacatactagctacttaggctcttgcactataacttcctaacagcaaatcagggatataaataggaccttctgtactgggttaaattggatcccttccaaaaatatgttatgtccaagtcccaacccccagtacctgtgaatgtacctttatttgccaacaaaggtctttgccaatggaatgaaatgcaggtgatgtactggattagagtgggccctcatcctatggctggtatccttataagaaggaaatgtggacacagaaacagaggagccagacatacacacagggagtgaagacggagacagagatttgagctatgctgtcacaggccgaggaatgcccagaagcgtcagaagataggaagaggcaaggaagcgttccgcacagagcgtggcccttgattttggacttctatcctccagaattgtgagaaaatacgtttttggtttgtggctgttacagcagtcacaggaaatgaacacgccgtccttgtgggattattgcaaggatggaattcgctgctattatgtctagctaagcacaccctgttgctgcccccaactcccatctcccccctcaacactgccccccaggccagcaggaccctgactgtactcaggggcccattccgtctcatcatgggtcaaaggatgccaagccaacccccagttcaaaggtgaaccttgagtggtcccagtcactcataacagtcccatttcctttgcctatgattgacttaaacgtgagcccatgactcagttctgaccttgaagctgggaagggatgttcgctgggcggggggcttctgaaaaaagcctcctgtctattaagaagaaaacaggaaaaaaaaaaatagtccctcttctgtctcaggatttaacaatgtctggatgcaatacccagaacagctttgggaatctggcaccatgcggggagcccgcccagaaagcagagccaagccacagagaagggcagataggagagatggaaagggtctggacccttgattggcaccattggtggtgcctacacccaccttcctctaggcttccaagagtagagctgccatatgtatctaaaccacagcacagtgctctagttatagaaaagtgtcattgtttaagccagtatggattgaggtcctgtcactaacactcaaaagcattctaagtgatacaaaaatcattcacaaaaacggagcaatgatacaaaatgacacagtacgtggcccagagtaaatgtcagtcagtgctttaaaaaaaataacaagccaagcagtgcacaatggctcatgcctgtaatcccagcactttggggggccgaggtgggaggaccaccggagttcaggagttcaagaccagcctggccaacatggtgaaaccctgtctctactaagaatacaaaaattagctgggcatgggggtgcacacctgtaatcccagctactcgggaagctgaggcaggagaatcacttgaacccaggaggcagaggttgcagtgagcagagatcgagccattgcactccagcctggacgacaagagcaaaactctatctcaataataataataataacaagccagtcatgatggttcacacctgtaatcccagagctttgggaggccaaggtgggaggatcacttgagtccaagagttccagaccagcctgggcaacctagtgagaccctgtctctataaaaaatttaaaaagagccaggtgtggtggtgtgcacctgtagtcccagctgcagggaaggctgaggcaggaggattgcttgagcctcgcaggtaaaggctgcagtgagctatgttcaccccattgcactctagcctgggcaacagagtgagaccctgtctctaaaaaaagtaaaataaaataaaaacaataacaggcatagatcccagatggtagacattaagatagtgcccaccacatggaggcaagccaaagactgggcagatggggagagagccgtggagtagaatcaagatgttcttgttgcacacagtttctctgtttccctttaatgaaatgtggtttcaaatgccactccgtctcagccatgttatgtgtgctgtgggatattagcgaaaggtccacgcttccattgttggccagagtgtctcttaggcgatgtggatggggcaacagtatccagtatccagtgaaaaatccccaaggggaaggtaaatgccaatgacacaaacccgggaaggtatttggcaatatctgacaacagtttaaagcttatactcctctgatccaactatccttctttgagaatcctcctacagtaatacctatgtgcaaaataacacatatgtagagacattcattatgccattgtttgagtaacaaaagtcaagaaataaaggaaatgtccaccaataagggactgggtgagctgagcagggcaatgcagcagctacagagtgaaactgccttataaacactgataccaaaccctcgccaaacttattctaatagacagaaaacagttatgtaataaaaatgaaagagtgctgcagggcagcgtgggccacgcgtgtagtcccagctatcaggaagctgaggtgggagaatcacttgagcccaggggttctgggctgtagcatattatgccgatcaagtgtctgcactaagtttggtatcaacatggtggttttgggctgacacagtggctcatgcttgtaatcccagcactttgggaggcaaaggcatgtagatcacctgaggtcaggagttcgtgaccagccaggtcaacatggcaaaaccccatctctacaaaaaatagaaaaattagcctgacgtggtggcgggtgcctgtaatcgcagctacttgggaggctgaggcaggagaatcgcttgaactcaggaggtggaggttgcagtgagctgagatggtgccactgaactccagcctgggcgacaagagcgaaactccaactcaaaaaataaataaataaaatatagatagatagatagatagatagatagatagatagatagtgacctgccaggagcaggggaccaccgggttgcctaaggaggggtgaactgtcccaggatggaaatgaaacaggtcaaacctcctgtgttgatcaatagtgggagagcacctgtgaataaccactgcactccagcctgggcaacatagtgagacccgatctctaaaaatattaattaataataataattaaaggattatgcataacaataaaattcagaaagatttttgatagaggtgatatgattattagcaaaatcatttaaattcggaaaagcgtaggactgcaaacttaaaattttagtcattgttctcctgagatgggaaaaggctgtgattcttcatctgaagagtcttatcttgggtactacttgccatcaatgacgaattgtttaaatttgaggaggagcgaactgaattacattggtctatgccaactaaggcaggttagattgaaaagattgttgacaaaaggaaaaattaaaaagggaagacagagtatttggttcagtgaaaaggctacaacagcgaggacgacacttgggaaccagagcagcacctcgtgaactgtcaggaatacatccacgacttcaacagacaccacacggaaaggcagaaagagagcacattgaccagaacaaacaggtcctctcccaacaatgctaggaaacaaatctccagatccacaaacagcagcttttctaagtcctctcctaaggcaccagtgattgggagagatcacgaatccaaaaacagccagctgtttgctgccagccagcagttcaggaagaacacagctccgtctctctgcagccagatgaaaatggacctagtgaagtcaggtatcaagatcctcatgcctaagagccccattaagcaggacgcagtgaatggctttcagagtgagagctccaaaaaactggaccccacagagcagggtcaggaggaatggtagtacccaaagtggcagcggaaaagccagacaaagctttattgggccctggtactgagcaggccaggatggggagcaagcctggatacacctgctagtgcctcaggtgcatggccccgtaagtgcagccatggccacaggcctactcgttaacaggaaagctacatctacattcatggatgcattaacagccagtgggacaaccaacatacagacatctgttacagcagtaactgtcagcaaaaggaaatttattgacaacagaagagaacagccttttaacaaacgattgcatttcagtgtgaggcaaacagaaagtgcctaaggatacagagttattgtggccgggacaaaagatggcttcacccacatcttattcactagatcaacagggaataactcagtaaatacagctgtaatgaaaaaagtctaccagctctgacaaccactgctgattacagcaagcttgtactgctcagcgcctttaacagtgtcttctgttgtggacttgactttatttattttatgcagtgtttgacagatgacagaaaaagagaaagcattaaaatgggagaacctatcagaaacgtcgtgaataatctatggccatatcactctgaaagtgacagaaaaaaagaaagtgttaaataggcagaagctaacagaaacttcgtgaataatccctggccataccacccgaaataggcacgatttcttcggatatcagaagctaagcagtatctgccctgtatagtgcatggacacaaggaactttgtgaatactattactccgttcaaaaaacctgttactgaagtaaaagaagttatctgaaacatcatgaataatctatgaccatacgaccctgaatatgatacaaaaagagaaagcattaaaatggcagaagagaagctaccagaaacgtcgtacataatctacggccatagcacagtgaacgctccaatctcatctggtcactgaagtacagagtacacgagattgcgcccagggtacggcctcttcagtacttggatgggaggaacttcgtgaaggctatcatttcactcaaactgaatattattgaagcagtcactatcccagccattcgactagaagcatccgtattgcccctttatgatatggtttaggctaatcaaaagacttggtttccaacaacctcttctacctctgagcagattccagacagctgatttaccattacgtttccgaaatcatgggacgaccagctgcaagcgagacgatgctcagtgggttgaaactgatcacacagaaggcatttggcaacggccttctctcccagctgtttgggtcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacacggaccacatcgggttccagctgagaagaacaccattgcttccatctgtccttatccattctcacagcctgaaacaagctcactggtagcttatgcttgcaagcaggactgggaacattcacgctatttattcgggagtactgactccagaaagtacagcaaccttggactgctcagcgccattggtagggtcttccgtggtgcacttggccttatttattttttacgacatttgacagaggacagagagagagcaagcattaaaacggcagaagctactggaaacgtcgtgagcaatctacagtcataccaccgtgaacgctcccaatcttgtctggtctctgaagtacagagtagatgcgattgggcccaggttggggcctgtttcattgttggatagaaggaacttcctgaatgctttgttccgcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcactgggttgaaactgatcacacaggaggcatttggcaacagccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggatccagctgagaagaacaccattgcttccggctgtccttcttcattctcacagcctgaaacaagctcactggtagcttatgcttgcaagcaggaccgggaacattcacgctatttattcgggagtactctggataaatcatcccattattttggaaatgtaatgctaggtcaggtatctggaatcttcctggaggtagaagagggtattggatggaaggaacttcgtgaatgcgatcattgaactccagaaagtacaccaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaacaagtcagccgcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagacgatgctcactgggttgaaactgatcactcaggaggcagttggcaacggccttctctcccagctgtttgagtcctggaccttcacttaggaaattggtggctcagatcaagaagcttgtctcatgtaatcgaatagtgctggaggaatccaaagccttggtgtgctgcaacatgaagaggcatctggaacaggccaacgagagaacatgtgaagtactgaagaaaatctggggttgtgcccaagggttggactccatgtgaaaggacttagaaaggaagatgaatgagtttccattgtcaggctgcacactgaccacatcgggttccggctgagaagaacaccattgcttccatctgtccttatccattctcacagcctgaaacaagctcactggtagcttatgcttgccagcaggactgggaacattcacgctatttattcgggagtactgactccagaaagtacagcaaccttggactgctcagcgccattggtacggtcttccgtggtgcacttggccttatttattttttacgacatttgacagagtgcagagagagagcaagcataaaaacggcagaagctactggaaacgtcctgaacaatctacagtcataccaccgtgaacgctcccaatattgtttggtctctgaagtacagagtagatgcgattgggcccaggttggggcctgtttcattgttggatagaaggaacttcctgaatgctttgttccgcttaagctgcgtattgttgaagcactcaatggcccagccattcgaccaggagcatccgtattgcctctttgtgttatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacaatgaccacatggggttccggctgagaagaacaccattgcttccacctgtccttatccattctcacagcctgagacaagctcactggtagcttatgcttgcaagcaggactaggaacattcacgctatttattcgggagtactgactccagaaaatacaggaagcttggactgctcggcgccattggtagggtcttccgtggtgcacttgggttatttattttttacgacatttgacagaggacagagagagagcaagcattcaaacggcagaagctactggaaacgtcgtgaacaatctatagtcataccaccgtgaacgctcccaatcttgtctggtctctgaagtacagagtagatgcgattgggcccaggttcgggcctgtttcattgttggatagaaggaacttcctgaatgctattgttcagcttaagctgcgtattgttgaagcactcaatggcccagccattcgaataggagcatccgtattgcctctttgtgatatggtttaggctaatgaaaatacttggtttccaacaccctcttctacctctgggcagattccagatagctgatctaccattacgtttccgaaatcatgggacgaccagctgcaagtgagacgatgctcagtgggttgaaactgatcacacagggggcatttggcaacggccttctctcccagctgtttggaacctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacatggggttccggctgagaagaacaccattgcttccaactgtccttatccattctcacagcctgagacaagctcactggtagcttatgcttccaagcaggactaggaacattcacgctatttattcgggagtactgactccagaaagtacaggaaggttggactactcggcgccattggtagggtcttccgtggtgcacttggccttatttattttttacgacatttgacagagggcagagagagagcaagcattaaaacggcagaagctactggaaacgtcgtgagcaatcaacagtcataccaccgtgaacgctcccaatcttgtctggtctctgaagtacagagtagatgcgattgggcccaggttcgggcctgtttcattgttggatagaaggaacttcctgaatgctttgttcagcttaagctgcgtattgttgaagcactcaatggcccagccattcgactaggagcatccgtattgcctctttgtgatatggtttaggctaatgaaaagacttggtttccaacaccctcttctacctctgagcagatcccacatagctgatctaccattacgtttccgaaatcatgggacgaccagctgcaagcgagatgatgctcagtgggttgaaactgatcacacaggaggcatttggcaacggccttctctcccagctgtttggatcctggaccttcactcaggaaattggtggctcagatcaagaagcttgtctcatgtaatcgaatagtgctggaggaatccaaagccttcgtgtgctgcaacatgaagagggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatggggttccggctgagaagaacaccattgcttccacctgtccttatccattctcacagcctgagacaagctcactggtagcttatgcttccaagcaggactaggaacattcacgctatttattcgggagtactgactccagaaagtacaggaagcttggactgctcggcgccattggtagggtcttccgtggtgtacttggccttatttattttttacgacatttgacagagggcagagagagagcaagcattaaaacggcagaagctactggaaacgtcgtgagcaatctacagtcataccaccgtgaacgctcccaatcttgtctggtctctgaagtacagagtagatgcgattgggcccaggttcgggcctgtttcattgttggatagaaggaactttctgaatgctttgttccgcttaagctgtgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggctttctctcccagctgtttggatcctggaccttcactcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggatttagaaaggaagatgaacgagtttcgagtgtcaggctgcacagtgaccacatcgggttccagctgagaagaacaccattccttccgggtgtccttatccattctcacagcctgaaacaagctcactggtagcttatgcttgtaagcaggaccgggaacattcacgctatttattcgggagtactctggataaatcgttccattatttcggaaatgtaatgctaggtcaggtatctggaatcttcctggaggtagaagagcgtattggatggaaggaacttcgtgaatgcgatcattgaactccagaaagtacaccaagcttgtactgctcggggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttggatggaaggaactttgtgaatgctatcatttaacttaagctgtctattactaaaccagtcagccgcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatagtgctggaggaatccaaagccttggtgtgctgcaacatgaagacggatctggaacaggccaacgagagaacatgtgaagtactgaagaaaatctggggttctgcccaagggttggactccatgtgaaaggacttagaaaggaagatgaacgagtttcgagtgtcaggctgcacactgaccacatcgggttccggctgagaagaacaccattgcttccatctgtccttatccattctcacagcctgagacaagctcactggtagcttatgcttgcaagcaggactgggaacattcacgctatttattcgggagtactgactccagaaagtacagcaaccttggactgctcagcgccattggtacggtcttccgtggtgcacttggccttatttattttttacgacatttgacagaggacagagagagagcaagcattaaaacggcagaagctactggaaacgtcgtgaacaatctacagtcataccaccgtgaacgctcccaatcttgtctggtctctgaagtacagagtagatgcgattgggtccaggttcgggcctgtttcattgttggatagaaggaacttcctgaatgctattgttcagcttaagctgcgtattgttgaagcactcaatggcccagccattcgactaggagcatccgtattgcctctttgtgatatggtttaggctaatgaaaagacttggtttccaacaccctcttctacctctgggcagattccagatagctgatctaccattacgtttccgaaatcatgggacgaccagctgcaagtgagacgatgctcagtgggttgaaactgatcactcaggaggcatttggcaacggccttctctcccagctgtttggatcctggaccttcactcaggaaattggtggctcagatcaagaagcttgtctcatgtaatcgaatattgctggaggaatccaaagccttggtgtgctgcaacatgaagagggatctggaacaggccaacgagagaacatgtgaagtactgaagaaaatctggggttctgcccgagggttggactccatgtgaaaggacttagaaaggaagatgaacgagtttcgagtgtcaggctgcacactgaccacacggggttccggctgagaagaacaccattgcttccacctgtccttatccattctcacagcctgagacaagctcactggtagcttatgcttccaagcaggactaggaacattcacgctatttattcgggagtactctggataaatcgtcccattatttcggaaatgtaatgctaggtcaggtatctggaatcttcctggaggtagaagagggtattggatggaaggaacttcatgaatgcgatcattgaactccagaaagtacaccaaccttgtactgctcagggccttaggtagggtcttctgtggtgcacttgaccttatttatgttttacaacgtttgtcagaggacagaaagagaacaagcattaaaagggcaaaagctaccagaaacatcgtgaacaacctacacccataccactgtgaacgctcccaatctcgtctggcctctgatgtacagagtagaggagattgggcccaggtaggggcctgtttcatagttggatggaaggaactttgtgaatgctatcatttaacttaagctgtctattactaaagcagtcaacagcccagccgttcgactaggagcacccatattgcctctttgtgatatggttttggctaatgaaaagacttggtttccaacaccctcttctacctctgggcagattccagatagctgatctaccattacgtttccgaaatcatgggacgaccagctgcaagcgagacgatgctcagtgggttgaaactgatcacacaggaggcatttggcaacggccttctctcccagctgtttggatcctggaccttcaatcaggaaattggtggctcagatcaagaagcttgtctcatgtaatcgaatagtgctggaggaatccaaagccttggtgtgctgcaacatgaagagggatctggaacaggccaacgagagaacatgtgaagtactgaagaaaatctggggttctgcccaagggttggactccatgtgaaaggacttagaaaggaagatgaatgagtttcgagtgtcaggctgcacactgaccacatcgggttccagctgagaagaacaccattgcttccggctgtccttatccattctcacagcctgaaacaagctcactggtagcttatgcttgcaagcaggaccgagaacattcacgctatttattcgggagtactctggataaatcgtcccattatttcggaaatgtaatgctaggtcaggtatctggaatgttcctggaggtagaagagggtattggatggaaggaacttcgtgaatgcgatcattgaactccagaaagtacaacaaccttgtactgctcagggccttaggtagggtcttctgtggcgcacttgaccttatttatgttttacaacgtttgacagaggacagaaagagagcaagcattaaaagggcaaaagctaccagaaacatcgtgaacaatctacagccataccaccgtgaacgctcccaatctcgtctggcctctgaagtacagagtagaggagattgggcccaggtaggggcctgtttcatagttgaatggaaggaactttgtgaatgctatcatttaacttaagctgtctattactaaaccagtcagctgcccagccattcgactaggagcatccgtattgcctctttgtgatatggtttaggctaatgaaaagacttggtttccaacaccctcttctacctctgagcagatcccagatagctgatctaccattacgtttccgaaatcatgggacgaccagctgcaagcgagacgatgctcagtgggttgaaactgatcactcaggaggcatttggcaacggccttctctcccagctgtttgagtcctggaccttcactcaggaaattggtggctcagatcaagaagcttgtctcatgtaatcgaatagtgctgaaggaatccaaagccttggtgtgctgcaacatgaagagggatctggaacaggccaacgagagaacatgtgaagtactgcagaaaatctggggctctgctcaagggttggactccatgtgaaagtacttacacaggaagatgaatgagtttcgagtgtcaggctgcacactgaccgcaccgggttccggctgagaagaacaccattgcttccagctgtccttatccattgtcacagcctgagtcatgctcgctggtagctcacgtgtggaagcaggactcggaaaatccacgctatgtattatcgagtagtttgaaagtactgtagctttaaaataaaataaaatcacttaaaataaaatgaaatactacaatgcttttctgtctaagcatcagtattttatagtcatatacacacaactataacagtttaatggtgatcacaggattgctcttagaagctctaatttctcttgtctttggctagtactgtataaaaccagaagtgtgttttattgattttggtgacagaaaaatctgaaataatgtttgttttggtcatgttttccttctagaacagagaatctaaaggggtattagcccgcctcacctcccctgtcctacatagagacacagagtcatctgaggcattggctttttctccaagtaggtaccgatacctcagattcgggaaattccaaatcaaaaataagacttagcttctacaacaaatacttctgatgaaacattcactgaggagcatactcctaaaccagacatatgtttaagattcatgctgagatatcagttggtttccccttccttttaaaatacatccagttcttacccagttactataagcaaagcaatgtctctagaagaaagctttctttgcagtattagtgaagcactgaatagcttaagtttgaatatctaggttacaagttagtctttggcgggttttaaatagttttttgacccttttgaaatataactatatgagtgcttcttgttgctgggtgagaaatgctactttatatacagttttggttttcgttttgcagatatgattgatgtattacaccacaataaagtatttttatgtttacatagtgtaatttttaggttcacttagaatacattttatttaataaattaaaattatttcggtacactattaaatgcaaaatctcctttccaaacaaaaaagaactaccttatattcgtcattgaatgttcttggtctgtgcttttatgtttatataatatggtgaattcagtatggtgtccaagtgtgccctgcgttgatagacacgtgccttccttccaggagtgggtactgactccagactccagatccctatttctagttaggcttctgagcttgcaatcatattgaatgtatgatgagcaaaataaaatcaaaaccttatttttgtacatttttgaaatatatacttagaactgaccacctccctggccccatggagagctgtatcgtgtgtaaagccgcctttaccttgattcatgcagtgtttttgcatctgtgggacctaccttttcgttcattagtttgaactatacataaactgtacgatctgtaaagtttttatataataaatattcacctgtgaaaactggttaaataaaactaatatttcttacacacgcacacacaaaaaagcattccacaatgggcatgacaaaaagtccctctttcagaaagatgcttctgcagtagaagttggctaccttgatgcaatgacatggccagttctgatcctctaatttgtttgggatgcttctgctacattttcaaatgacttcagtcagtggttcccacaaatgaaatatttgccagacaagacgttgttgcatttctgtgacttttacatttattaaacaattgcttcctcctcccagggtaatagcctccaatctccccactttttcaaaacattattgacaatttttctaccatatgttgacactgtgtttcaattctcgtatctttttattccctagggcacaattggttctgctatgacaatctccagggtaaggattcaattgtacaaggttatgtgagcttgcaaatgaaggagacagagagagagagagaaaaaaaaaaaaaggaaaaggtggaggagggaaggaggggacaagagggggagagagagaaagtacaaatgggagacctcaactctagccattaaaaatggtggttctaaaaatccaccacacagtcagaactcagctttttacatgtgctcacatccatacagaaaagacatgttttgtgtttttcctagtgaattcttggcaaatactgtcagttgtgaaatacaagatggggaactctttctctgaaaacgtagccggggaaaaatgatgcagttaggtggagaaatagctgccttgaaaaacaagtttccttgagttgatgaaacactagaggagagaagaggtccccttgcatgtcttccccatctctgtgtttatttgctgatccaaactgattactgttaaaatatgcatgccagcatttcattttcaacaaatgctactccaagtattcattagcgtcttatccactgtctctaaaataatctacagtggcctgaatagctgtagaatgacaggagaaagattgcaaggcgacgtgcatgggggccctgagggcaaggcacagcttgctggctccgtggtaaggggtgggtacttggcatcagcccctcagcagagagggcaggactgggtgtagcaagtgactcacagaaaatgcattaccccattgaaatgtcaccagaattgaattgaaatgtcaccaaagaagctcatggggtgagaaattgccatgtgctttaaaaaataattattattaaatccaactaaagcatgtacataattgaatctgaggtactagcaatccttgttccatctttcttcacccccatcctccaccccaggagcaacaactttccactccattctgttccttctagaattttcctctatatttctaaataattttcatatactgttatttctcaatttattaattttagtcatttttatcaacttctgttatgatactggagggtttttctggcctaactaccccagtttgccttgacccatcccctcaatttggatactatgagttaaaaaaaaaattaatcgtctttttttttttttttaaagacagggtctcacttcactgcccaggctgaagtacagtggcacaatcacggctcgctgcagcttcaacctcctgggcccaagtgatcctcccacctcagcctcccaagtagctaggactaaagacacactccaccaaactcagctaatttttaaaactttatagagaaggggtctcactttgttgcccaatctggtcttgaactcctggcctcaagcaatcctcccacctaggcctcccaaagcactaggattacaggcatgacccaccacacctggcccctaatacagtctttctgttattatagcttaatatgctctctgttgatccacgtggcaaactatgactgcatttcctttcttgtacaactctgagtattttctgggattaataactgtctcatgtaattgcttagttttctagagatgttctctgatttttttccaaatgctttccccaaatgctcacacacattaaataacctaactcgcccatgtctccacccaaacactgccactgagagccatgtgtcctcctgctctgcaatataccagtttagctttaaacccagcacacggctagtgtcctaaaataccccaacctctttccagcatgggaccttgtctcctggtttccttgtcttcctcccttcctggtttactattttgtgttgctgaaatacattccctagtagctcctacagagacgtgtacaggagagatatatttttcatccttgcacatttaacaacctgttaactttgccctcatcactctgcccgagtgagtgctctctgcactgcaccctcctcagaaatttaccattgctccacttcccccgcagtattagccctaaggaacctgccgcctttgaactgtcaggtgtggcctgtttgcctctgtagaaacttttagcctagtgctgaccaaagtcaatcgcaattttctttctttttttttttaacttaaaatttttctttcatttccacgtttccccaacttattttttctttgggtgtgtgtgtgaagcaggatctcactctgtcatccaggctggagtgcagtgatgcgatcacggctcactgcagcctccacatcctgggttcaagtgatcctcccacctcagtctcctgggtagtggggactgcaggtgcatgccgccacatctagctaattaaaaaacaattttttttttgttgcccaggctggtctgaaattcctgggcttaagtgatactttccgatcagcctcccaaagtgctgggattacagacgtgagccaccgcacctgtcctcaatttttctttctttctttcttttttttttttttttttggagactgagtctcgctttgtcgcccaggctggagtgcagtggcacgatctaggctcactgaaagctctgcctcccgggttcacgccattctcctgcctcagcctcctgagtagctgggactacaggcgcctgccaccacgcccggctaattttttgtattttttagtagagacggggtttcaccatgttagccaggatggtctcgatctcctgaccttgtgatctgcccgcctcggcctcccaaagtgctgggattacaggcgtgagtcaccgcgcccggccccatcctcaattttctaatagacataatttaaatggtaaaaagaaagaagtggaattcgttttaataatgtattttatttaatccagtatatttaaaaatgctatcatttcaagctgcaatcaatatgaaaattttcggtgagacattttactgtgcctttgttatcatgagtgtatttcacactctcagcacgtctcagtgtggacctgtcatgtgctcagagctccacagccactggagccgacagccgctacatgactgtgtagttctacagccttctgtccatccctggtgctctggggtgcccacagtggtcctcattggcatttaatctctgtgcttgtgcttgtgctgtgtccctccagaatctttccagaatcatgcctcctatgccgtcattgctaaagtccccctctgggaccagaggtcctcctggtgaggccacggcttctgaacgccatgggcatttggggttcccacacaccttgtcacacctaaagccacaagagtcctggtgctcaagtgctcgagtgcagaagagggacttaaggactgcagcccgccaaccttcccagcaggtgtcggtcacaccaggtcatgtcactgccgaggatttctcaggtccccagggcatggcctgagattcttggaatcctgcaggatttcttagggtttcaacatttcctgctaaagaaccaacaattcctggaaggggcgacgcttcagcctttattgagcaacgtgcaaaaagaaaactggtgggccaggtgcagtggcacatgcctgtaatcccagcactttgggaggccgaggcgggaggactgcttgagcgcttagagtatgagaccagcgtgggcaatatagtgagaccctgtctctacaaaaataaataaataagaagaagactggcttacagccagcagagacgagaccttgcctcagtgggcctcaggcgtggggaactgggctcaggcagggagagggattggagagacagagggtgaggagagaggaatacagggcacaccttgtctctttcccatgtcgctgaagacatcaaggactctctctctctctctctcctcatgcccctccttcccttcatccccctctcccaccaacgtctctctcttccaggttcccaggaggcttaaggagaatataatccctttacgtctgcttaggaggcaaaagattcctccctcgtatttgtcatcttaaaacaacagccaagagcatgccccctatgcatttgtcaaatagcgtttgccatcagctggacacttccacacccttctacaagaatgacctcattgactccccgtaacaaccctaaagaagacattgtttctgtccctattttacagatgaggaaactgaggcccagggacggtcagggggtagccaggttgtgtccctgggggcggttccaaacttcatgctctcaccgtgagtggcagcttcctgtctctgtggggtgcctgcacaattaggggcagagtcagacatgtttgggcgttttgccatgaaatggtttactctgaaataaagaaagtctgtgggtgttggactgaattttgcagagtggatttaaatccagactttcgcagagtggatttaaaccagagattgagagcaagttcttagttctaaatgctcctgccagcttccatcctgaccagaaatgaaagcctggtgctgagaccggcccccagccccctgccgtaatcaccctgagtctagttcccttcactcacccccaccccgccagtacccccagggaaagtcagccaaaggcaggagaacatatctaacctctgtccagtaacaccttcaaatgtgaaactcccacttaattatgttgccattacattttagtccatcctgtctttcaactgtgaacacattttattttttccttcctgccttactcaactttcctgctttcagggtttgaatttcaaacctgtgcatgtttcttgctaggtgccagcaagctcataactaatgagatctaaggaatttggactccactaatttgcattacgggatggttttgacagaagctggcaatatcgaacctttgctgcacgaaaaaaaggcttgctaatcattttaatggcgtaaacatggcaggtcatggagccatgtgattgtttacatacatgtaaacagttcatgctgttttctacttgctcttttgtacacagtatctgctcttcggttttcgggactctcagtgcagctacctcatccttgggtaacttgagtgtccttttgctttttgctttgttgttacatttgcatttgacctgttattgtgtcccagaaagcatcttgcaggccacaccgacccgagaatgggtaaatatgttctgttttcgtctcttaaaaccctacgcgtctggcatttcagaagctgcgcgatgttagatcctttatgtaacaaccaaccctaggtggagagactgctaaaacaggaaaaaggttttctgaatcaatgagcaaaaccttgctgtgaatttcctaaagatggcacagacaggataaatacatactcccaacttggaaacagggacatttgaggcaaagcctccagcactaggaatacatattccagtcagagaaaaagaactggtaattgccaatctgtacatgagctgtgaggggagtccccatgcaatgacactgcaatcacctttgaactaactgtcaggaaataaataaataacggaatgtggcttttgagttttagtataatgtttcaataaccatctacgaataattagctgattcaggacaagtgttttcaaaagtgtattaaaatatagctctgatcgggcggggcatggtggctcatgcctgtaatcccagcactttgggaggccgaggcgggcagatcacgaggtcaggagatcaagaccatcctggctaacatggtgaaaccccgtctctactaaaaatacaaaaaattagccgggcgtggtggtgggagcctgtagtcccagctactcgggaggctgaggcaggagaatggcatgaacctgggaggtggagctcacagtgagctgatatcacgccattgcactccagcctgggaaacaaagcgagactccgtctcaaaaaaaaaaaaaaaaaaaatatatatatatatatatagctctgatcaattaattggcacaaattctccttcgacaaagctaatgaatcgtttttcatgcattagtaaatattacataactagaaattgtgtcttcccttactgtggtgctgatattgttagcatgcatccaaaaatgtgaccttggatattccagatatattgttggattctagcatagtaattattatctcattttactgggttgtttttttttcctccaagcttcccccgaaaagtgctatactaattaggaattattctcatttgttcattaaagcaagccctcaaaagatatccttaagatcatgatttattaaccgaaaccagattattatatgttcccagcttaataaaagtataattaggccaggcacagtggctcacacctgtaatcccaacactgtgagaggccaaggagggtggattgctcaagcccaggagttggagaccagcctggggaacacagcaaaaccccatctctactaaaaataaaaaaaaattagctgagcatggtagagcacctgtagtcccagctactcaggagactgaggtgggaggattgcttgagtccaggagttcgagaacggcatgggcaacatagcgagacccccatctcttcaaaaaaatttaaaaattgggccaggcagcccaggtggctcatgcctgtaatcccagcactttgggaggctgaggtaggcagatcacttgaggacaggagtttgagactcttcaaggctgcagtgagctgtgatcataccactgcattccagcctgggtgacacagtaagaccctgtcgaaaaaaaaaaagaaaaaaaaacactacaatttttctttaaatattttatttatttatttatttattgagacagggtcttgctctgtcacccaggctggagcgcagtggtgcaatcacagctcactgcagcctcgacctcccaggaccaagagatcctccacctcagcctcctgtatagctaagactacagccatgtgccaccacactcagctaattttttatttatttatttatttattttgtagatacggggtcttgctatgttgcccatactggtctcgaactcctgggctcaagcaatcctcctgcttcagcctcccaaagtgttgggattacaggtatgaaccatcacacccagccattctctatttttctgaatttttttattgtgataaaatatatataacataaaaattgcccttttggccatttctaaatgttctgttcatgatgttgatcacatttatgatgttgtacaattatcaccaccacctgtctccagaactttctccttttcccaaactgaaactctgtccccgctaagcaataactcctcatgccttcctcctgcagcctctggtaacctctaatgcattttctgtctctgattctgcccattctagatatttcatagaagtgcaatcatacgctatctgtccttttgcatctggcttatttcatctaacccaatactttcaaagttcatccatgttgcaatatgactcagaacttcattcttttttaaggctgaataatattccattgtatggatatgccaccttttgtttatccattcacttgggctgcttctaccttttggctatggtaaacgaccctgcgatgaacactggtgtgtaagtatgtgtttgggttcttgcgttcaatcctgcagtgtatactacaaagacgaattgctggatcatttggtaattctacgtttaactccttgaggaactgcccagctctttcagcagctgctgcactgtgttacattgcaattggccatgtgtgagtgttccaatttctccacatcctcaccaacacttgttattttctgttggttgtttggttggttgtttaattttagccatcctagtaggaatgagcaacactcactcttgatagaaaaacacattgaagatctaattttggtgctgcagagaacagggggactgggtgattaggaagcaaaagaagcctctgggaaggaggagtagagaagtgaggggttagaaggaaaatgacatgggacagggatcataaactgtgcactgggtttatgttatcattagcctttccagaatatggaggcctggcctatatccctcaatcagggtctatataccaacaggaagaaatgcacatgtggatctctttcaccttacaatgctctgagtagagcaagataactcagagggaaaaaggctattttctgcttaactgacattactatccgataagccctagtctctgagcaacacagggggccgtaaattcattaggaatactgttcctacaaacttgttcaacctgtagccagaaacatccaagtttaaaaaaaaaaaataggtgtagtatactgcatagcatgttgtgtatcacatgtagtcaccattgaggatatttacctagtggtctttttcctttgttactacaatagacaattaaatgataaacacttttatatctttaagacatataaatagaaaaaaaatcaaggggatttgggtatttttcattatatttgtgtgtttatgataaaaaacacataactgggccagacacagtggcccatgcctatattcccagcactttgagaggccgatctgggaagatggcttgagctcaggagttagagacaagcctaggcaacatagggagaccccatctctacaaaacaacttaaaaattaggtaagcatgatgatgcatgcctgtagtcccagctacctgggagcctgaggtgggaggattgcctgagtccgggagttcaagaccagcctgggcaaaatggcaaaactccacctttacaaaaactacaaaattagtcaggtatggtggcacaggcctgtaatccaagctactcaggaggctgaggtgagaggatcacttgagtccaggaggctgaggctgcagtgagctgtgattgtgccactgctctctagcctggacagagcaagaccctgtcttaaacaaacaaaagtcacccagggggtaaacatcagagcctgatctttaaaatgatatattgtgtggttgaaatgttaaaaaccaaccacaccaagtgttggtgaggatgtggggaaactggaaatctcatacacagttagtacaaatgtaaaatgatacaaccattttgttggtttttttttatcgcttcacaaagtttgtttctgaaagagttaaaacatatatctataataggatccagcctttccagttatagatacttatccaagagaaatagcatagttccatacaaaaactgataagcaaatgctcatagcagctctatttgtaatagctggaaactgtaaaaaccataaacaatccaaatgtccatcaatagatgaacagagaaacaaaccataatgcaacatacagtggaatactactcagcaataaaaaggaatcgatgaccgatacatgaaacagcatgaatgaatctcaaaattatcacccttagtgaaagaaaaaatccagacaaaaaagaatacagactgtctaactccattcatataaactcaagataatgtggcaggaagcagaccagtggttacttgggaatagaagaatggggaagggctggagggaggggttacaaagggcttgaggaaatgtttagaagtgataagaatagtaatggacagaatcatggttccccaaagacttccatgtcctaatccccagaacctgtgaatatgttactttacatggcaaaggggagttaaggatgtagatggaattaaagttgctagccggctgactttaagattatcttagattatccggctgggacaatgtaatgacaaaactccttaaaaacggaagagggaggcaaaagcattcagagtcagaaggaagtatgactacagaagaatggtgtgttggccaatattgagttactgtaacagaatacctgaggctaggtaatttataaagaaaagagtttcatttggctcatgtttctgtggctggaaattccaaaattgggcaactgcatctggtgagggcctcagtctgcttccactcatggtggaaaacaggagagtgggtgtgtgcaaagagaccccatcgtgagaaaggaagcaagagagaaactgaggaagccagactctttttaacaacctgctctctcaggaactaatccattccagtgagagcaagaactcactcacccctgagggacagcattaatctattcatgagggatcttccccatgacctaaacacctcccactagcccccacctcccacatagccacattgaaaatcaactcacaacataagttttggactggaacaaaccatgtgtaaaccatagcaaatggtcagagagacgcaacattgctggctttgaagatggaggaaggggccatgagccaaggaatacaagaaacctctagaagctggaaaaggcaaggaaatagattatcccctagagtctccagaaaggagtacagccctgctgatatcttgattttggccctccaagaccccttgcagacttctgaccttcagaactgtaagatgataaaattgtgttgtttcagctgggtgtggtgggatgcacatgtaatcctagctactagggaggcttctttaaggccaggagtttaagaccaacctggacaacatatcaagactatctcttaaaaaataaaaacaataggccaggcaaggtggctcacgcctgtaatctcagcactttgggaggccaaggtgggcggatcacttgaggtcaggagttcgagaccagcctagccaacatagtggaaactcatctccactaaaaaagcaaaaattagcagggcgtggtggtgggcgcctgtaatcccagctacttgggaggctgaggcaggagaatcgtttgaacctgggaggcggaggttgcagtgagccgagattgcgccactacactccagcctgggcgacaaagtgagactctgtctaaataaataaaaaataaattaaaaaaaaaaaaacaattaaccaaacatggtggtgcacacctgagcccaggaatttgaggctgtagtgatttcagcgtgaccgacagagcaaggctctgtctaaaaaaaaaaaaaaaatttatgttgttttaagccactaagtttgtggtaatttgttaaagcagtcatagggaactcatactgctccactcattatttctaatgtggtgatggtttcacagatatatacatataacaaaacttatcaaattataattgtccatatgcatggtttattttatgtcaatggatatctcattaaagctgtttttttaaattatgatttttttttttttttttgagacagagtctcattctgtcacccaggctgaagtccagtggcacgaattcagctcactcagctcacctccgcctcccaggttcggctcattgcaacctcagcgtcctgagtaactgggattacggtcatgtgcaaccactcccagctaatttttgtatttttagtagtgatggggtttcaccatgttggccaggctggtctcaaactcctggcctcaagagatccacctgcctcggcctcccaaagtgttgggattacaggtgtgagccaccacgcctggtctcaataaaactgttcaaaaaacactttttgtggccaggcgcggtggctcaggcctgtaatcccagcactttgggaggccgaggcaggtggatcacctgaggtcaggaattcgagaccagcctggccaacatggtgaaaccctgtctctattaaaaatacaaaaaattagacaggcgtggtggtgacgcctgtaatctcagctacttgggaggctgaggcaggagaatcacttgaaccagagaggcagaagttgcagtgagccgagattgtgccactgcactccagcctggccaacaagagcgaaaactttgtctcaaaaaaaaacaaaacaaaacactttttgcaaaacagatcttctttgtgatttcttttttcaatcatcacatgcagaaatacataggaaagtagactgggcgcggtggctcacgcctgtaatcccaacactttgggaggccaaggtgggcggatcacgaggtcaggagatagagaccatcctggctaacatggtgaaaccccatctctactaaaaatacaaaaaaacaattagccgggagtggtggtgggcgcctgtagtcccagctactcaggaggctgaggcaggagaatggcgtgaacccaggaggcggagcttgcagtaagccgagatcactccactgcgctccagcctgggcaacagagtgagactccgtctaaaaaaataaaaaataaatttaaaaaaaagaaatacataggaagatcacccatgtcaattcaatggactttattatgaactgtatgcattacatatcactatatctctcataagtctataagctttactgtcacttgtacctgagggatattataggctggctcaatatgtttgacattggattacttacaagaaattaatctagcttaataacataaatattcatctgtaatttttctctcttctttggtattaaaataactaagttattaaattatatcacaaactgaactaaaaattatcataaaggttataactaaaaccaaagattatcaaccacactaaaaatctaagtgcacttacagtataaacaagagctcttcacagtgaaagaattatttctgtgtgtactcatgttcattacagatatacttcattagagtaaagtggagatctacctataataaattgttagctgtgtaaatacagcctttgaattaagagtcaaagaagtaggcagatcccaattcagtcctggtgtatcaggtagggtctctgcaggaagcagatggcatacacagaagggttaagtaaagacagttaaatgcagaagctatttacagagaaaggtggatagagttaagggaacccaactagaagctggaggggaagggagctaggtgtggaagactgtactgtttcttctcaattgacccattcctcccagccaatgtcacgtgctcctgtaggcagaatatacttccttgcccctttgaccttgagcttagccatatgacttgctttggtcaatggaatgcaagcagatgtgacaaacaccactttttatttttatttttatttttttttttgagacggagtctctttctgttgcccaggctggagtgcagtggcgtgatctcggctcactgcaagctccgcctcctgggttcatgccattctcctgcctcagcctcccgagtagctgggactacaggcacccgccaccatgcccggctaattttttgtatttttagtagagatggggtttcacggtgttagccaggatggtctcgatctcctgacctcgtgatctgcccacctcggcctcccaaagtgttgggattacaggcgtaagccaccgcgcccggccgacaaacactacttctaacagaacttgaaatgcactggtgtggttggcatgcacttgagtgtctgcttttggccttgagaagagcaggtgccagataggatctggctccagatatgggaagagtgcatggaactgagccaagtctagtctgttagaactcagcaaaggcaaagctgatgcacagcctgcatgccttatgaacaagaactaaatgtttcctgcagaagcaaaagcacaccggacaaaccggatggtacagcctgcagggaccagcctccatgacacagcagggcaaagaagagccgagaacggatgtgggggcaaactgagaagagccacacaggagagcatggagggagaaatgcagggagattcatttccatgaagggctgaggacaagagacttcaagctgtgtggctaagaggcaaacaccacaagctgaatgaggggaaaggagtgaagagagggctctgaacagagagagcatcatgctgacactcaaatttgtctcctaaccaggtttttcactggatccatattctggtgccataacaaaaggagaaataacaagggatcacatgaaggactcagaaatattctgggatacattgccaagccagggcaatgtggtccccttttagcaggccacacatacaagaccaccctcagctttgacttgtgagggcttgcagtatagctggggtagtgcccaaggaggcgggcagaacagtggtgccctgcatgttacagtggtgccccccaggaggtctgtccttacaagcctgaggacattcctcaaccctctgtgaatttcttaaagtcaggaacccaccctcgcactctgcagatatgcgtagtgcacactttaataaatatgcaccagtaaatacttccagctgtgcatgtgtgtgcaagtggctcctcccccaagagatgcaataaatacatgaaatacggggctgggggggcgggggtgagaatgcaggatgactggggccttttccaggcaaagtcatttacccatcaccttgttggagtgtctgcacagtttatgctggacagtggcaagaaaatggattttctcatttgtcttggtggcagtctgacctcatctttgttttttctttgagataaaatctaacgagaaatttgattttctaacattttaaattaggatcctatatgggagaaatacagagtcttaaacaggaggacctagactaacacacagagtaagggaaggcattgctggagaagaaatatacacatagataggtagatagatagatagatagatagatagatagatagatagatagatagataatagaaagacagagacagagacagagagaaagagagagagaggtggtcttgttctattgcccaggctgcagtgaagtggtgtaatcataactcaaggcagctttgaactcctaggttcaagcaatcctctcaccttggcctcccgagtagctgggactacaggtgcatgtcaccacacctggctaattttctttttttagagataggatcttgctatgttgcccagactggtctcaaactcctgggctcaagtgatcctgctgcctgggcctctcaaattgctggaattacagccatgagccaccacgcccagccaggggaagcaatagcaaaggtgagatttaacaggttgacacatgcaaacagggcatgggaaaagcattgtaggcaggagtaaacaagtatatgtaattcctgagagaaaatggagaaaggttcccaacctcagacggtaaagggactcaggagaaatgtcctgtgaggccatttcatcatgtcacacgtggactgcgcccaccaagaagtgagggggaaagtaggcactgccctcaaaatcagagaatcctgcagaacctgatgacacgctctgagctttaaaaacaagtgcagcctgggtcccacccccagcaacattaatttgattcattgtcctgggatggggcctaggcttttgggaattttttttttttttttgacggagttttttgctcttgttgcccaggctggaatgcaatggtgtgatctcggctcactgcaacctccgcctcccgggttcaaacgattctcctgcctcaaccgcctgagtagctgggattacaggcataagccaccatgcccggctaattttgtatttttagtaaagacgggtttcaccatgttggtcaggctggtctcaaactcctgatctcaggtgatccgcccacctcggcctcccaaagtgctgggattacaggcgtgagccaccgcgcccggctgggcttttgggatttttaaaagctcttcaagcactttcaatgtatagccgacgttgagaatggctgatctaaagccgtggttctcggccgggcatggtggctcacgcctgtaatcccaacactttgggaggctgaggtggacagatcggttgagcctaagagttcaagaccggcctggccaacatggcgataccccgtctctacaaaatatacaaaaattagcctggtgcggtggcacaggcctgtagccccagctaccaaggagatgaggttgcggtgagtcgaggtgccactgcctggacaacagagtgagactctgtctcaaaaaaataaataaataaataaagccatggttctcaaacttcagcatgcatcagtagcaactggagggcttgttacaatatgaatggtggggacccactcccagaattcctgtgcagttctaacagtttctcaggtgctgctagggctgctgatcccaggatcacagtgtgagaaccattcaaagaagcgaggcaggagatgtttgagaaagatccagctgtaggagtcagggggcagggcctacacgtagataaaaggtggtaattctgggaaacttgcaggattaggggtaaggagggcagcggcagggaagaattcaatatggcactagagggtaggcacccctggagtgtgtataccctagcaactggaagccattcttggtagggcgaggtggctcatgtctgtaatcccagtgctttggggggctgaggagggaggattgctcgagcccaggagtttgaggctgcagtgagttatgactgcaccactgccctccagtttcagtgacaggaaggaaggaagggagggaggaagaggaagggaagatgggaggggtgggtcatttttgccagaagtccaagcaagtagccagggacagagacacccatctgaaagaagatccatccttgggctgtgtccccatccctggaggccagagacaagcctgtccctgaaagacaacgacacagagaacccagcatggatccagtcattgggcaggggcagaagaagcggacgaggcatcaggaagaaggagaggcagagctggtggaaccccgctggcaggcagatgttggggccagcaggaaaggagctgtaaagtttagagtccccaaaactcattgaggggaattccaatcaccatccattgagactttgattaggggctcaggagtcggcataattaacccatctgcccctcctcttccagtctaggtggtctagatttgataacactgctgggggaggggatgcaaaggggggcaatgtggaggtgaaagcaatgtggtgggagggatctggaaagagtaagtgtgtgggcagaatgctactacagcccaaaggtgctcacgccggtgtatacgccccatataatcccctccacttgagtgtgggcaggacccgtgaccattacgagatgccattcccatcattaggggactgattggttgcctctgagtcaaccaaacaggagattatcctgggtgagtctgacctaatcaagtgagcccttaaaaaacacagagacttttccgttggcttcagagatgaagcaaacagccacagtgtgaactgtttgtgggaaggaacagcctctaggagaggaggggccacagccctacaaccacaaaaaactgaattctgccaaaattcaatgagctggaaaaagaactccaagcctgggatgagatccagacccaactgacaccttgatttcatcctggtgaaccctgagcagaggatctggttgtgctgtgcccagaattctgaccaaggtaaagtataaggtagtaaatgtgtgaagcttctaagttcatatataatatatattatatatcatagtcatatgtatatgatttattatttgttataaggaattggctcacgtgattatagaggccgagaaatcctaagaactgcagttggcaagatggagacccaggagagccaacagtataagttctaggtgagtccaaagtcctgagaaccaggagaaccaatggcgttaagttccagttggaaagtcagcaggctgctgatgtttcagctcaattccaaaggcaggaagactgatgtcagctcaagcagtcaggcagcaggagctccctcttactcagcctttgtgttctatttaaggcttcaactgattggacaaggcccacctgtactgggagggtaatctgcttcactcagtgtacagtgcaaatgtgatctcatccaaaatcaccctcacacacacccagaatgtctgacaaaatgtctgggcaccctgtggcccagtcaaatggacaaataacattaactgtcacaccagtccaccaaggaaaacttcctcagtctgtcaccattttaatatatttttacaaacttttatttatttatttatttatttattttgagatggagtttcactcttgttgcccaggctggagtacaatggcatgatcttggctcaccacaacctccgcctccagggttcaagtgattctcctgcctcagcctcccgagtagctgggattacaggcatgcaccaccacatccggctaattttgtgtttttggtagagacagggtttctccatgttggtcaggctggtctcgaacttgtgacctcaggtgatccgcccacctcggcctcccaaaatgctaggattacaggcgtgagccaccacacccggccttttacaaacttttaaaacttgctagcatgtggaagatggacgcccactgtctgactacatccagaaagagtccagtctgcctttggtcctgtgcttgaggggaggtatctaagtttcctctttcttttaagctgttgacaaatctcattgcacttttttttcagtaaagttgtggcatacccccatccccgaaaaaaactgctagcatgaaaagaacagttgggccatactccctttatagtttttttggggggctttttggttgtttttgagataggatctcactctgtcacccaggctggagtgcagtggtgcaatcagagcttactgcagcctcgacctcctgggctcaagtgattctcccatctcagtctcctgagtaactggaaccacaggcatgcaccaccacttgggaccacaggcatgcaccaccactcctggctaatttttgtagaccatgttgcccaggctagtcttgaactcctagtctcaagggatcctcccatctcagcctctcaaagtgctgggattataggcatgagccactgcgcccagcctggagagtgatcttggatgagattcacatttgcactgtagagtgagtgaagcaaattgccctctctactgtgagtaggactcgtcccatcagctgaaggttactgaaagccagatactcctggcctctaacgatccgcctgcctccaccccacaaagtgctgggattacaggcatgagctaccacacctggacactttgtagttatttgtgtgacttcaatgaagcggggattggccaaagagaactcagtgtcctggaggaaggcctttaatattactttctagcataatgaagtggctgttttattttaagagttatgaagttcactgcaaggttttcaggtacctgaattccaaccccagacttctggggccccctgcactccctgagatcggggaagcacagcagctccttattccaaggaagggcagggtccctgctctgagagcccccaggcacctctgcccacccgttacagcactcattatagtctgatgtagggtgggcttatgtccttccataggcttcatgcttttccagggcaggagtcatgtcttcagtgttctgggttttcctgagcacttagcagtgggcacttgcaatcctccaatgttggttaagtgcatgcactattaatagcattccatccacgccaggcgcggtggctcatacctgtaatcccaacactttgggaggccgagacaggcagatcacttgaggtcaggagttcaagaccagcctgaccaacatggtgaaactctgtctctactaaaaatacaaaaattagctactcggaaggctgaggcacaagaatcgcttgaacccgggaggtggaggttacagtgagccgagatcacaccactgcagtccagctctgggcgacagagtgagactctgtctaaaaaaacaaaaaacaaaaaaaaaaaaaaaacaagcattccaatagcaactttccattgcacagcaattcattctccaagtgtgttcctcggacaaacattcacatctgctgggaacttgttagaaatgcagatatggccaggcgcagtggttcacgcctgtaatcccagcactttgggaggccgaggcaggcagatcacttgagcccaggagttccagaccagcctggccaacatagtgaaaccccatctctacaaaaaaatacaaaaattagctgggtgtggcatgtgcctgtcgtcccagctactcgggaggctgaggcaggagaatcgcttgaatccgggaggcggaggttgcagtgagctgaatcacgccactgcactccagcctggtgacagagcaagactctgtctcaaaaaaaaaaaaaaaaaaaaaaacggatacttgggcctccctcacacctgctaaatcagaagctcaatgactggggcccagccatctgggttccataacccctctggaaggttctgatgtgtgtgcaagtcagagagtcactgctctagcctaatggtttgtattttgggtcaatcagccccttcataattctcaggtctcttccccccaatttcttggtagttgttttatttcgtattttgcactgaattctgcaaagtcatctaagtaatattgtgcctgctcacacttgtactaattgagatccatgtttcagtgaatcatcatagcttcaatgtgttgagcaaatactgtataccaagcctagtattgaatacagaaattaccttgccctcaaatccaccctgtgagagaggtaatgctagccccagttctcagaggcagaatctgaacacagctgtttaagtgacgtgtgtatgttcccatagcaggtcatgctgcacttgcaactcaaaatcaccctcacacaaacccagaatgtctgaccaaatgtctgagcaccccatgacctagtcaagtggataaataacattaaccatcacaccagtccaccaagggaaaacatcctcagtctgtcaccattttaatatatttttacaaacttttaaaaattgctaggaggtggaagatggacacaccctgtctgactacaatatccagaaagagtccagtctgcctttggtcctgtgcttgagggaaggtatctaagtttcgtctttcttttaagctgttgacaaatctcattgcactttttttcaataaagttgtgagattccccccgccccccaacaaaaagttgctagcatgaaagaacagttaggacacattccctttgtatttttgggggggttgtttgtttgagacaggatctcactctctcacccaggctggagtgtcttgcttcaaagttggtgtttgtgaccccagactaaatagtcttggaaccttagactctgtcttacaataggcaccaatcttttagggcatccaagtattttgcaacaaaaagcagcttgatggagctagcacgaagtgccaccagtcaagcttgcaagagcaacaaatgggttcttcttgctgaattgtttaaccacgaaatgtgtttgtcctgcaggcttattagcaaagcgtactcttttgttctgggggaagacccacgcctctttaaggaacagagcagaccatgccaaaagcacttcaaggccttccttatcgctgtcaatctggcaccctgtgaaagctgcggggcctttctactctgctccaagctccctgctccatccagctggtcctggaatcagctttctctgcctgccttcatgtcaccctctcccacctgaactccctccccggagccttccaagcccacccttctcttccactctaacctccacagcatttcaggcactcattgaccatctctctgacattgggtgtggcaccatgatcatgtttgggggtccctaagcaaaccctgacacatacatgggccattctgcctcctgcctcctagtccccaatgatagacattgtcacctaatgcctgagcaccatgaaaactgagggaaagaggaagaactgcatcttcctcctcctcagaggtctccgctggggactggctgattcctttagggccttaaaacatttccatttgcagaatgcccctaataaaatggagaagtaaagctataaatccttaccgtattattttcagagcaagaaagatggttacagatgggtggcagatgggtagcgatggatggaatcagtcgatggatagtaagaataggtcctgtagaaataaaacacaagcatttgtgtattaattactgtattaagtctgtttagactgctatgacaaagtagcatagacagggtggcttaaccaacatcgatttattatccaacagtcctggaggccggaagtccaagatcaaggtgtgagcacggctggttcctactgggacctctccttggcctgtagatgctgtcttctccctgtgtcctcacatggtggtccctctatgtgcatctgtgtcctcatctactattcttataagaattctagtcgtattggtttagggcccaccctagtgatttcattttatcttaattgcctctttggagatcctatttccaaatacattcacattctgaagtaccagggcttagggcttcaacatatgcatttgtggggggagcataattcagtccataacacttgcccattgctgagtaacaaactgccacaaatgcagtggcttaaaataacacacgtttgttatctcagaatctccatgggttgggaatttgagctcagcttaactgtgccttttgctcagggtttcacaaggctgtagtcaatgtgtcagcagaactgcattctcatctagaggcttggatggaaaagaatccaccatcaagatccctcaggctgggtgtggtgactcatgcctgtaatcccaacactttgggaggttgaggcaggataatcccttgagcccatgagtttgcgaccagcctgggcaacatagtgagaccccatccctagaaaaaatttaaaaatttgaaaaattagccaggtatggtgatgtacacctgtaatccaagctactcaggaggctatggtgggaggatcacttgggccctggaggtcgaggctgcagtaagctgtaactgcaccactgcagtcctgcttggataacagagtaagactctgtctccaaaaaaaaaatggtttcatgactcagggcactggcttcttgcaggctgctggctggggggcggtcctgggggggctgcccttggttccttgccccatggctgcttgcttcttcaagactgtgcatcagggaacctcgtcactggtgtggcatcccatctcctctgccatattctcctggttagaagcaaaacaggctgggcacggtggctcacgcctgtgatcccagcactttgggaggccaaggtgggtggatcacttgaggtcaggagttcgagaccagcctggccaacatggtgaaaccctgtctctactaaaaatacaaaaaaattagccgagcgtggtggcacacgcctttagtcccagctacttgggaggctgaggcaggagaatcgcttgaacccaggaggcagaggctgcagtgagcagagatcactccactgcactccagactgggtgagacggagcaagactctgtcaaaaaaaaaaaaaaaaaaaagaagcaaaacatacgtcctacccacacttaagaggccagaaggccagaatcccacaaaagaacagggatcatgaagacccccccacctccccccgccccgccaaaagcaaagtttgttccacacaccttgagggtgggagaaatgagagaaaaaatagtaatagaaagccagcagcacagggtaaattttgccccttcacaagtttgcctgaggttgggccacattcactcacccaatccccaaagttatcttttagaccatccaccccaacaacctggagcagtcactgttttgcaagagctttagatgaagactgtaatgaaacaagatcaagggaaagactggttttaagtatcacttactcatcttcctccacctgcaattttcagccccaaaataacttggaggaaaaaaaaaacccctggattatttacatttgctctctatttttaaccactcttctgtttaaaacatttaatatcttctgaagccccattagagcctatttaacctgtagcaagatatcgtatttatttttgcagctattttcatctgcttagggaactttttgttttcatctgagctttcagaaggaagttaagcaaggtcaacaggcctggctgacttgtcaactggttgtgctgggttcttaatcataaaatggagctaaattcagagcaacttatcatgcatctctttttatgtggctcagtttttccattacttgaagttcccaaacattaataaacctaaatgcactatttttggtgggaatgaatgcattatgcttttcagagttgatgttttttacataactaaatcatgttggcaagagggaggagaaaccaccctttgtagggcatatagcgattggattttttcctactgatctggagctgttgaagcagggaatgggggagggggaagaaaggggaattcggcacagggaaaatacacccacagattctgttcactatttttacttgatattttttgtgctacaggttgcttttgcaaccactaagcaaacattttcaagaggctttaatgaaaaagatgtgtttggaagaaagcaaaatgactccacaagactctaacagaaaatacacttgtaattctttgagctgtagttaggataaacatttgatcctagagacaatctagtcacgtgaaaccaaaagcctgtagtctcagctactagggaggctgaggcagaagtatcacttgaacctgggaagcagaggttgcagtgagccgagattgtgccactgcactccagcttgggcgacagagcaagactccgtctcaaaaataaataaataaataaaataaagacaaaaatccaacctagcccaaggctggtgcagtagacactgcaacagaatataaaatgagtgattaaaactcaacaagaaccattcaggagacccatgagctggaatattctgttttaccctcttccttctcttccccaccccaccacacctttgccctccaagggttatttttgctgcacgttactttattctttttcaaccagctttggcacaaaaatgtagtgcttaagtgtttaatattatattattcatatttccctcttgatgtgttctaattccacccttcaatgttggacaaagacatacaaattgtatttctacactttgattttgcttgacaggttcttgtagctaacagccactgaccatttctgtagatggtagaatccatagatcgatacagctttcaatatgttccaaatctggtattgcttatcctttttctgtgagctaagctgttatcatttactgtctctatgaaggaagaaaacagttatttgcccaatgaagcacaagcaatcaacattctggtttcaatatagatggctgaggaatcagtgctgggaaatgtgtgaggggactgaacctacactaatatgtatatttgcagtaggttctgatttcaggtgttcctttttgctacttctgaaataaaaacttggccaaacatcaagtagaagggtcttttgtgcttctgcagtccagtggggaaatggtttctggttactttttcatgtattaaattaattttattttgaaaaaagttttacgaaagtttttcctgtgtttttttttagttgtgatgaaattcacataactaaattagccactttaatgtgttcaattcagtggcatttagcacatttacggacttgtgcaactttcacttccgtctagagccaaaacattttcaccagcctcccaaaaagccccatacccattcaatagtcactccccatcctatcgccttcttccagcccctggtaaccactaatctactttctgtctctatggatttacctattctggacatttcatatgaatgaaatcatgtgatatgtgatcttttgtgtctggcttctttcactcggcataatgcttttgaggttcttccacattatagcatgtgtcagtaattcattaaatttatttttaaatgaaaataatatttaagggcattttcctgtgttcaactatttattgatcacctgtgtgcaaggcactgtactatacatagcatgctggaaaggttggcattctctgtgaaataattgtaggacacaagcatatgagtctcctgcctgcagcaccccactcccatgcctcagtctctaacataaaactactagaggtggctggttcccaaagtagccaaatccctgtgactcataggcttttccaccctcccttctccccttcttagacaagatccgtttcccccaagaccacacaagccattttagaattgtcgtttgaactcatgatatgtcaatgaacagaaagcatagcactgtgactgtcataaagaagagtcggccctcaggagaggcccagcttgcagggtagaaacgcaaaatgcagacagcagtggtaactgatgacacagactacacggcttcctccagtacagagggtggcccccaaggctcagggctgtgaaaggtcccggaggcctcaccgaagcagtgagacttggacgaaggggcgggagggagacttggacgaaggggcgggagggagacttggacgaaggggcgggagggagacttggagaggcagggtgatggccttcatggacaaagggaagatttgaacaaagacttggccgcgagaatacacgtggcctttttaaaagacgagacacagaccattttgtttagaaagatttgtttggaaacgaacatgcagcgatgtcaacgttggttcacttgaaagggaagcaaacgggaaaataacatcccactttccttcagcccccgcccacaacccccgccttgtacctgatcttctccagcccaggagcaaccacagtagaccactgagacgtctccccacgtctttccatcatatcttttttcccagccagccctaacggaacccaggtggttccttcaacgggtcccacgcggcgcggggcggagggagggggactaactctgggcattctgtctctccgtagtttggttcccatcatgcccctctcccaaggtcctgtcatggccgctctcttaaagcagttttccattatgcccctctcccgagggagtttcccgccatggccgcgtcccaaaacagtttccagtcggccgggtgcagtggctcacgccttaatcccaacactttgggaggctgaggggggcggatcacgaggtcaggagatggagaccatcctggctaacacggtgaaaccccgtctctactaaaaaaaataataataataaataaataaataaataaaattagctgggcgtgttggtgcacgcttgtaatcccagcttcttgggaagctgaggcaggagaatggcgtgaacccgggaggcggagcttgcagtgagccgagatcgcgccactgcacgacagagcagcctgggcgacagagcgagactccgtctcaaaaaataaataaataaataaataaaacagtttccagtcatgcccccttctcaaagaagtttcccgtcgtgtctctcttccttgcccctccccactcttccttcatttatttatttatttatttatttatttatttaagacagggtcttgatctgtcgcccaggctagagtgcattggggagaatatggctcactgcagtttcaatctccgagttcaagcgatcctcccacctcagcctccctagtagctgggacgacagggtatgccaccatgcccggctaatttttgtagtttttgtagagacagggtttcactatgtcagccaggctggtctggaactcctgggttcaagtgatctgcccacttcggcctcccaaagtgctgggattgcagggcgagccatggagcccggcccctccccactcttcaaaaccctcggctccagctctgaagcagagctcctccctcgtttgtatcctcacttagtgtatcatactcttggaataactactcaaccaatcaaagaaaggacatttttccccacccaggtataccttgggcatcacgaatgatgcggggacatcatggaccttccaactcagccaggcagaaggaggtgtaaagtgaaagcctcagctgggatacgaggcaggatgtgctaagttccccatggttggtagaggccccaagcgctccctgatactcagaaaagacaggaatagctgagtgccgctggaaaagcaggcaggaagtgaagtaggtggggaggggcaggagattgttacagttacaggagcaacccgagagaacaaagacaccacggttaaagctggctaaagtcagaggcgattcagagactgtcagaataatccagttatggggaaagaggtcctgagcaggggcagtggagctagaaggaaagggcaggtgataacggctggcaaaggcaggaggagctggatgggaagcttgtggggacttgttgggattggtggggaggagaatagttacagaaggtttcaaggctaaggtttgggtaacttggagaaggttgtctatctgacaaaagttggaaattcagtaacagggacagagtttccttgggtgaagggtgagatctgggccagatcatcactaggagtccacagatacagccccaagcccctagggtggagtcgcactccttccacagaggaaaaggagacagcaacaggacacacagaagaatcataacctgctactaggcatgacgtgggacccctgtcacatttgtttatggaacacttagctctttggggttcccagggactaaagtgtgtgcctcaaaacacaccctaacggccgggtgcagtggctcacgcctgtaatcccagcactttgggaggccgaggcgggcagatcacgagatcaggagattgacaacatcctggctaacatggggaaaccccgtctctactaaaaatacaaaaaattagccgggcgtggtggcacatgcctgtagtcccagctactcgggaggctgaggcaggagaatcacttgaacccgcgaggcagaggttgcagtgagcctagatcgcgccaatgcactccagcctgggcgacagagcgagactctgtctcaaaaaaagaaaaagcaaaaaaaacacaccctaagatgctgcctgtttctctaaacaggctaaatgatgcattagcttcagccgaatcgttctcaccagtggaaatggtgacctgcttctagtgacgcaccctgtgtgcagagctgcatggcttctcagcaaggccacagcctctcggcgtcctcaatggccgtggcagtgggaacaaagatgtgagcgctggtgtccttggtcctccctgtctactctctccaacccaatggccagtaagggtctcatacctgctttggttcttggagaaggccagggactgagtaagtgctggtagaccgtgagcacatgtcagacattccccaccataatctcccagaaacccagccagcagatgaaagcaggtgaaaggaaaggaagcgatagaaagagttcctgccagggaacaggcgtgtgctgttttgagttttccagacccgcactgcagtggagattgtggaatttgcaggcctcaacatgttggtgaacacaatttcttcaattatcctcggtaatttatggtggactatcatgaagtcacactagatgtgcctttgaaaattagatggttttctcctttcattttaatatttctgcatttcattgaataaaattataaatagggcaatttcaaaaagaaaggaatacagaatagcaaacttttagaacacccattaggcaaagtccaaacttagaaaaatagatatgtaaatcctcgtgagacgattaaccttcaccccaaacacacacactcatttctactatttatcactcagaacttttatgagagttaagagtttctcctaagactcagggatcatttctatagtttgttactagagaagtttctctggatgtgtagagcaccgtaaaataaaaggaaaatgaaaaaagaataaaaaatttttaaaaaagagcttgtctcctaagagatgataagtttctagaagataaggctgtgtctttttttttaattttttcccccacaaatccataaaatgtactcagtgaatgtttgtttgatcagaattaaatttgtattactaaaagggtttttgttttcagcttgtttatttttgctagaggagccagtgagttgctattttaagaatagctttgaatcatgacttaggaagtcagaattgtattaaatgaagtagtatctaaaaacttccagatccattagaaattataactaatgcaatttgaaaagagagttggatcattcattttatacaagtctctgttttcaatgactttcatataaatgaaccctaacaaaaatttttacctactttttgattaacttatccaatggtatttccgctctaaagtattttacatggcaaataaaatatacaactttgggctgggcactgtggctcatacctgtaatcccagcactttgggaggccgaggcgggtggatcacctgaggtcaggagttcgagaccagcctggacaacatggggaaaccccgtctctactaaaaatacaaaaattagccgggagttgtggcggcacctgtaatcccagctactcgggaggctgaagcagaagaatcgcttaaacccaagaggcagaggttgcagtgagctgagatcgtgccattgcattctagcctgggcaacaagagtgaaattctgtctaaaaaaactttatgcttgtaactacatttctgtcatatttatatagcttctgaaatttgcccataggttctggcaaagttgtttttttcttacaccaagtgaacttacagttaaaaaaaatagaaagtatttaaacctgaatgatttctgaggttgtagcagaaggatctcccaaaggaggaaaaaaaaacccttaccttctccttatgtgcagtctctttcacaaatacataatttaataaggatttgtgtaaatttaccttgtattttttttttagctaaattagttttacatataatatctaatgcaattttctcacgaaagtgggaaggtactattattactattattattagtatcccttccttatttacaaacagaaaatcttggaattcagaaggacaaagctgcataatttgctccagctacacagctactaagtggcaaagccaggtgtctggattccaacgttcacggtctggtccagtgtaaaacatttacacttggatcccttacaagtctataagtgctttattgagtatgcttaagtagaaaaataattcctgaaaactcagttcaaaattaaatccttggagcttacacagtaaaattcaactttcacttttgtgggccaagaactcctgcttaggtgccctggaacaggaaccccagtgccttgctgacaaatggtcttcatagaacacaaatggcccttcgtcatgctagaaccaattgtatcacttgtgtgtatctaagaaacccaaggcagttctccaatcctgatagaccagtcaggattcaaccagacaactggaaccagtagaagatacatgctagatttattgcaaggaattggcttatgtcattgggtggggctgggcaggcaggcctgaaatttgtagggaagacagttaagaaggcagactggaactctcttgggcactggctgttcacaggaggaatttcttcttccttagggaagcctcagtcctgctatagaggcctttcacctgattatccaagataatctctcccccggcttaaagtcaactgattatggaccttatttacatctcaaaacagcctggaagcaacacctagattagtgtttgtagtgggttggattgtgtatccttaaaaagataagttcaagttctaacccctggtacctgtgaacggggctttattcggaaataaggtctttgctgatgtgatcaagttgaatgaaggctatactgaattaagggaggcggtaaatccattaactggataacctgtgtctttataagagaaagaagagggagatctggacacacacacacatacagggagggagaaggccatgtgaagatggtggcagatattggagtgatgcagctactaagcaaggaacaccaaggactgccagctgtcatcgggagctggaagagacagggaagcatcctcccctagagccttcagagggaacatggccctgccaacatcttgacttcagacttctggccttcagaaatctgacagaataaatttatgttgtcttaagccatctagtttgtggttccctgtttgagcggccctagagaatgaaaatggtatttgatggaataactgaggattgtggcctaggcaagcggacacatcaaaagaccaccacctctccattcccttctcttctcctttcccttcctttccctcctttccccttcccttccatctcctccccttccatcccctccccttcctttcccttcccttccctccatctcaaccctcttcatgtccactgagctcatattctggctgggggaacagacaattaaaactaatgagcaagccaggcgcagtggctcatggctgtaatcccagcactttgggaggctgaggcaggaagatcacttgaggcctgaagttcgaaacaagcctgggcaacatggcaaaccccatctttaccaaaaaatacaaaaattagctggccatgttggtgctcgttagtaaacctagctactcaggaggctgagatgggaagatggcttgagcctgggaggccagggttgcagtgagccatggtcaaaccactgcactccagcccaggagacagagccagaccctgtctcaagaaacaaaaacaaaaaactaatgagcaaatgaacatgaacatgttagcccatgaaagaaagactggtgaagagggagggagagggcacccatcagagcagagaccgaaatgctcggagaagcctggggtccctcctggaggagacgtcctcacagaagcagcactgggtgcaggtgacaagaagctgcaaacattcagggaacagcacaagcatgttgaggagtgggtgtgcagggaagaaagaagagcagggaaaatgggaggagatggagtcttctaccactgtatttttgttgttgtttttatgagacagggtcttgtctgttaccaagctggagtgcagtggtgcaatcatggctcactgcagccttgacctcctggtctcaaatgatcccacctcagcttcccaagtagctgggaaccacaggcgcaccaccacaccctgataattattttaaaattgtttttgtagagatggagtctcactatgttgcccaggatggtcttgaacttcgggactcaatagatcctcccacgtcagcctcccgaagtgcttggattataggcatgagccaccacacccagcttctaccacttgttggtttttaatttgcatagtgacaccttttctcaaaaaaaatgcaattgtacatgtgtgtagtatagaaattttgtatgtttcaaaataattatctttcaaatcagctgcagtgcagcattctaattttttaagcaaacttgtaaaatgttagaatagtttcagttacagaaagataagattgagagttcctgtgtataattcagtttctccattgttaaagccttatgcctccatagtacttttgttacaactatgaaactgatcttggtacataactaataactcaatgcccagtttttccatgtatgtcctttttctgtcctagggccccatccaggattatacattgcattaagtcatcgtatcaccttgggctcctctgggctgtgactggctcaccatgcttccttgtctttgatgccctcgatagtttggagcagtgctgattgggtattttgtggaatctccttcagtttaggtttgtatgatgccttctcatgattggactggggttgtggatgtttggacattcttaggtttttatttacagcatttcattgcatacctaatgtttcaacaaacattaatctatcttaaaaatagaatcacatatttaatgcagttattgtaatgtctatctttgtcccctttatacaaaaatacagaaaaccaggagagaggcagccaccatttcatattcttagctcatacgtgaaacctttccattttaaacttctgggaagaactttaacattaaaaattcaaaccactttgaaattatgtagtcaactgaaaaagtttattttagtcatctaaagggacctgtgcaaaggaaaactactcttttagaagcatacttctttttttttttttttttttttttttttttttgagacggcgtttcgctcttgttgcccaggctggagtgcaatggcacgatcttggctcaccgcaacctccgcctcctggattcaagttattctctctcctgcctcagcctcccaagtagctgggattacaggcatgcaccaccacgcctggctaattttgtatttttagtagagacggggtttctccatgttggtcaggctggtctcaaactcccgacctcaagtgatctgcccgccttggccccgcaaagtgctgggattacaggcgtgagccaccgcgcctggccagaagcatacttatttttctcccattccagaaaacattccttgcctggtgccctgaccgttgctgaaaccattccttgaaacgtctctacctgctgatgtcaatccgcccaacatccatgcagttggatagctgtgtgctgctgcaaccttttgtgagtggggggagttttattttaaatagttatctctggccgggcgtggtggctcatgcttgtcatctcagcacattgcgaggctgaggtgggtggatcacttgaggtcgagagttcgagaccaacctggccaacacggtgaaactccatctgtactgaaaatacaaaaattagccaggcatggtggcgcacgcctgtaatcccagctacttgggaagctgaaacacaagaattgcttgaacctgggagatggaggttgcagtgagctgagattgcgtcactgtactccagcctgggcgacagagcagactccatctcaaataaataaataaatacacaaataaataaatagttatctctaaaaacgtgatcaattctcactaatatctcagaagtatactaaaatgtcctttcccttccctcccttccctcagggacatttcaaaatttctataagacctgtatctggtcttatcaaatggctgtgctctagtgaaaataacaacaaaccttaaaggcctccttacacaggtactgggggaaaggctgggctctaattccatgtagctttactgtgcctttctcaaatttgctaaaattcaagcttttagtgtacagttggccctctgtatccatggcttccacatgcgtgaattcagccaacttcaaatcaaaaatacttgaaaaaaaatggatggttgcgtctgcactgagaatgtacagacttttattcttatcattattccctaaacaatacactataacaactatttgcacaacacttacactgtattaggtattataactaatctagagatgatctaaattatacaggaggctgaatgaggtggctcatgctgtcatcccagcactttaggggaggccaaggcaggtggatcacttgaggccaagagtttgagaccagcctaggcaacatagcaagaccctgtttctgcagaaaatacaaaaattagcttgggtgtggtggcacatacctgtagtcccagctactcaggaggctgaggtgggaggatgacttgagccaggagttcaaggctacagtgacctatgattgcaacattgtacttcagcctgggcgatggaacaagaccctgtctataaatataatatgtcaatatggccgggcacggtggctcacgcctgtaatcccagcactttggtaggcctaggcgggcagatcccctgaggtcaggagttcaagaccagcctggccaacatggggaaaccccgtctctactaaaaatacaaaacttagctgggcgtggtggcgtgcacctgtaatcccagctacccaggaggctgaggaaggagaatcgctggaacccgggaggcagaggctgcagtgagccaagatcgtgccactgcactccagcctgggtgacaacagagcaagactccgtctcaaaaaaaaaaaaagaaagaaaagaaaaaaagaatacattaattaactaaataaaataaaaataaattatacaggaagatgtgcataggttatatgcaaatactgtgccattttatatcagggacatgagcatccgtggattttcgtatctgcagagagttctgcaaccaatcccctgtggatactgagagacgactatacagttctatgagttttgaccaacattgacagttttgcaaccagcactaccatcaagatacagaacagctcagtccctcaaaaatatccccccatgatcctttgtagtcaaccttttccccaacctactctcaatcccaacaatggagggtctttctgtcccagtagttttgcctgttccagaatgccatatgaaaccatggaatatggcagagtgtggtggctcacatctgtaatcccagcactttgggaagccgaggtggaaggatcgcttgatcccaggagttcaagatcagcttgggcaagatagcaagaccccatctctacaaaacagaaacaaaacacaaaaccatggaatatgtcacctttgaatctgaattccttcactcagccatttacatttgagattcatccatgctgttgcacagatcaatagcttcctccttttcagtgttcatggagtcaacactgaaaagtgtatatccgtacaaggggatatatccatatccatatccatgtccctttgtatggacatactgcagtttatttatcccttcaccagttgaaggacacctggattgtttccaggttttggcaactatgaataaaggtttctgcatacaagtttttgcaggaagctaagctttcacttctcttgggtatacatgtaggaagggggctgtcagggtatattacacatgatgtgtgtcccatcttatcaagtgcctgctgattctgtaaaagtaataacatcaaagaggccttgtgacaaaggcgctggagaaaaacgccacgttccactcccattgagtttcacttgtgcttttcttaaagaaatttctttttttttttgagatggagtctcgctctgtcacccaggctggaatgtggtggcgcaatctcagctcactgcaacctctgcctcccgggttcaagcgattctcctgcctcagcctcccgagtagctgggactacaggcacgtgccaccatgcccggctaatttttgtattttttgtagagatagggtttcaccatgttggccaggctggtctcgaactcctggcctcaggtgatccacctgcctcggggattttctttgttaatgtggtgtggagcttcactgtgtgggagatgaatttttgtgaagaaactgtctataaaatcctcctgtctcccatgcttattctctacagccagtgttaaaagttaagcatgaaatgcagaagtgtcgtcgggcgtggtggctcctgcctgtaatcccagcactttgggaggccgaggtgtggggatcacaaggtcaggagttcgagaccagcctgaccaacatgatgaaaccccatctctactaaaaatacaaaaattagccgggtgtggtggcgtgcgcccgtaatcccagcaactcgggaggctgagacaggagaatcgcttgaaaccgggaggcagaggttgcagtgagtgcattgagccgagattgtgccactacactccagcctgggggacagagtgagactctgtctcaaaaaaaaaaaaaaaaaaagaaatgcagaagtggaaacaaatggtggggtgggggagaagtacataacttcttttttttttttttgagaccgagtccgttctgtcgcccaggctagagtgtagtggcacaatctctgctcactgcacttactgcaacctccgcctcccagtttcaagcgattatcctgtctcagcctcccgagtagctgggattacagctgcccaccaccacaccggctaatttttgtacttttagtagagacggggtttcaccatgttggccaggctgttctcgaactcctgacctcaagtgatccgcctgcctcggcctcccaaagtgctgggattacaggcccataacttctttcaaggaaatatggttaccaaaagaaaggcgggaaggggaggaaacccttgaaaaggataatctctcttattttgtagctataacagccacgtgttatttgagggaaattgcaactcttgcctgtcatgtgctctttgagtaaacacaggcagcattttgtatttatttgatttttggtttgctttccatgttggtgaaagtgggctctgaacacgttcaccccttgagagacaccaaggttggtgtgaggtgggctgtgggttttggaatcagaggagctggatttgtatgtgttctgcccccttttagtgggagacattctacaagcccactgtggaaggcagaatgtggtcccctgaaatcgtccgtgctgggatccctgggaacctgtgaagacatcaccttccattgcaaaagggactacagatgtgactaacatgaagagctctacaatggagagattattctggattatacaggctataaatcctgggttacacaggatctttaaacatagaggaaggtagaagaagaggaggtcaaaataatgctatttaagagggacttgaccttctgttgctggcttgaagatggaggaaggaggtcccgtgccaaggaatgccggcagtctctagacactgggcaaagtcaggaaacagattttcccctagagccacagaaagaatttcttcctcttccccttccccttcctctccttctccttctccttcttcttcctcctccttctcctcctctccttctccttcttctcctccttctccttcttctccttcttcgccttcttcttccccttcccctccttctccctccctccctctctctctttctttcttctctcctcctcctcctttctccttctctttctacttttttttttttttttgagatagagtctcattctgtcccccatgctagagtgcaatgacacgatcacagctcactgcaccctcgacctcctggactccagcaatcctcccacctcagcctcccacgtacctgggagtacaggcacatgccaccatgcctggctaattgttttcatttttttaaagatggggtcttcttatgttgaccagggtggtctcaagctcctgggctcaagcgaccttcctgccttagcctcccaaagtgctgggattgcaggcgtgaaccaccatgcccagccgtggaacacagttttgctgacaccttgatattatctaatgtgttagtcagggctctccggagaaacagaaccaatattatatacatacatatatatatatatatatatatatatatatatagagagagagagagagagagagagagagacagagagagacagagagagagagagagatttattattaaggtattggctcatgagattatggaggctgagaagtctgtgatctgctatctgcaagctgcaaggctagcggtatagtttaaaagcctgagagctagagggccaatggtgtagactccaatttgggtctgaaggcctgagcacccgaagtatagagggcacatcaatgtctcagctcaacagtcaggcaaagggagggcaaatccagccatgctctgcctttgtgttctgttcaggccctcagtggctcagagggtgctcacccgcactgaggagggtgatctgctttacccagttcagcgattcaaatgctaaatctcatctggaaacaccctgaaagacacatccagaaataatgtttaatcagttatgtggacatcctgaggcctagtcaagttgacatgcagaattaaccatcacccccagtgacacccatttgggatttttgacctccagaaccatcagataatacatgtgtgctgttttaaaccactaagtgtgtggcaatttgttacagcagtgacaggaaactaacccagccactaacctctctgagagtcaacttttctcccttgtaaaatgaatatgatcatgacaatatttccccaaccacttcatacgttactatgacaatcagtgacagaatgtttgaaaatgtttcgaaactataaaagctttgccagatcgaaaacaaaatctgctgctccctttgatctagtacttttcctacccactcagctcttcctttgctggccggcttctgcatctcctagggtacatttgatttggccaatctttccaatgacctttaccttttctaaatggggggctgggccccaggcactgaccatttctgctctttagaatccatcatcatcaccaaacagaatgagctttatctaacattttggtattttgttcacaatggagtttttgcatcacttttgagttttaaaatacggcattataatattatttatcttgatgactgcatttagagatgacaacctcatctctataaaaaataaaaaattaggcctggcgcagtggctcacacctatataatcccagcactgtgggaggccgaggcgggcagatcacctggggtcaggagttccagaccagcctgggcaacagggtgaaaccctgtctctactaaaaatacaaaaattagccaggcgtggtggcacgtggctgcaatcccagctacttgggaggttgaggcgggagaatcacttgaacccaggaggcggaggttgcagtgagtcgagatcacgccactgcactccagtctgggcgacacagcgagactccatctcaaaaatgaataaataaataaataaataaataaataaataaataaataattaaccgggcatggtagcgcatgcttgtagtctcagctactcgggaggctgaggcaagaggatggcttgagcctggttgggggttggagtctgcagtgagctgtgattgtgccactgtactccagtttgggtgacagagtgagaccgtgtctcaaaaaaaaagaagagaaaagaaaagaaagaaatctgatgtgtgttccaagcaggttgctgtggaagcagatttttgttttgtttggtctcatgactactttgaaatgatggaacttattagaatcacctctacagtctgaattgaatgtattgaaaaagcagcacatatattactatatcagaattttaaaaaatattggatgactatgttttaacacaattgggtttctttgtaatcttatgcattatttgatgtatcaatgcattattttacgcatttagaaacaatattcactaaattgctgaaggaggtctgaagcatagacatattatgattctttccctcaattcttttttttttaaattttctacttccagtttatttattttatttatttattttgagacaggttctcgctctgtcatccaggctggagtgcagtggtatgatctcagctcactgcaaactccgcctcccaggcttaagtgatactttcacctcaacctcctgagtagctgggactacaggcatgcgccaccacatccggctatttgtatttttgtagagacggggttttgccacattgcccaggcgggtctggaactcctgggctcaagtgatccgcccgccttggcctcccgaagtgctgggattacagccgtgagccactgcgctcggcccttctctcaattctttaaccttttgagttcaattttatcctctgaatattgggccttcagggaggacctggaagaatcaaatatgatactgtacatgaacacctccatgccaaatgcaaagtactttcaggattcaaatgataactaaatgcaaaatttgaaatgaaaaaagaaaaatagcaatagctcacatgcattagtctgctgagtctgctgtaatagagtgggttgcttaaacaccacccatttattttctcacagtcctggaggataaagtccaaggtcaaggtgttagcagggttgggttattctcaggcctctatccttggcttatagatgactgatttctccctgtgcgtgtctgtgtcctaatctccttttcttaaaaggactccagtcagattggattagagcctacccaaatgacctcattttaccttaattaccttcttaaaggccctatctccaaatacagtcacattctaaggtactggggatcaggacttcaacatacaaatttttgtgaggacactattcagcctggcccataacatcagggaaaacaaacaaaacaaaacaaaaaacgaaaagaagtattgggtggctacctaggtcaagggatacaaaaggggttttcatccaccttatctcagctccatgacaggtgataggcctttttatcttcactcctttttgtatacctctctaagtaggacctcacataatgccacctatacaagtggcttccttcatagttttggttctagtctctctaaggaaaattagaagcaaaattcaaaagcaaagaaagatcagatgtttgtaagtgaagttgaaaagtccatccccccttcctcatctcatatgggaagctcgtggtgggtgcttattcagagaaaagtcacatctataaacatcaaggaaagatcatcacttccagcatgccttcaatttcaatatcttgggagagcaagaatggacttttgtgcagcctacacatatatctggaggttgccaaacaacactaccatgagcttcccacactagatcagttcaggaaacagatatgaataatttgctttatcatgagtggttctttatgtatagcagctagtgaataccattgtcatttaaagcaaacttggactttactttgactttgtacctagggacctatttgcactgtctggtctttcttttgagtcatataacagtcatatcacatgaaaagttagggatatcattcggcctctctcctctctaaacagatgataagatctacttaaactttggttaaaaaaaatggagtagaaggccaggagtagtggctcacgcctgtaatcctaacactttgggaggccgagaagggtggaccacctgaggtcaagagttagagaccagcctggccaatatggtgaaaccccgtctctactaaaaatgcaaaaattagctgggcatggttgtgggcgcctgtaatcccagctactcgggaggctgaggcaggagaatcgcttgaaccgggaggtggagtttgcagtgagctgagattgtgccattgcactccagcctgggccacagagcaagactccgtctaaaaaaaaaaaaatggagtaggaaaggggcaggcatgaagattgtaatctaacagtgaggcaagtggatcccaggaatttgggtcaatccttggaagatcagggatttctgactaggccagtcatggaagcaagtattggcccatgtgtcaagagtctttgaaaattagatgggcctggggaaaattagacactaaagtcagtgaaaaccaggcagtaagtcatgagaagttcaatatctcttcctcctgtcttttttctttttcttttgttttctttctttctttctttctttcttttttaagagacagagtcttgctctgtcacctaggctggagtgcagtggcacggttatagctcactgcagccttgaactcctaggctcaactgttcctcctgcctcagcctcccaagtaagtagctgggactacaagctcagatcaccatacccagctaatttttttatttttgttttttgtagagatgggatctcactgtgttgtccaagccggtcttgaactcctgggctcaagtgattctcctgcctcagccttccaaaatgctaggattacaggtgtgagccacagcatttggcacagtgtttcttttttaaaaaaaaataaataataggcttttttttaagaagagctttagatttgcagaacaactgagccgatagtgcagagttacatgtttctctccccagcttccagtgttattaacatcttaagttagtgtggtacatttgtaacaactaaggagccagtattcatatattattattaattaaagtccatagttacatgagggtttcctctttgtgttgtacattttgtgaattttgacaaatatatatacacacacacacttatatgtataataacgtgtatccaccatcatagtattacacagaatagtttcaccactgtaaaaacccactgtgttccacccattcatcccttcttcctccttgaacccctggcaaccactgatcttattgttgtcttatctgtttccccttttccagaatgtcatatggttggaatcatacagtatatggccttttcagactggcttctttcacttagcaataggcatttaaggttcctttgtgtgttttgggggcttgataacccatttctttgtagtgctgagtaatattccattatgcgggtgagccacagtttgtttatccattcgcccagtgaaggatactttggttgcttccagtgtttggtgattacgagtaaaggtgccataaacctctgtgtgcaggtttttggagcacgtaagttttcagcttagttaggtaaatacctaggggcacaacggctgactgtatggtaagactctgtttggctttgtaggaaattgccgaactgtcttctgaagtagctgtacaattgtgcattcccattagcaacaaatgagagttgctgttgttctgcatcctgtcagcatctgggattgtcagttttctggattttagccattctaatgtatgtagtagtatctcattgttactttaacttgcaattccctaatgatatatgatgttcagcatcttttcatatgcttacttgccatctgtatatctctttgatgagtttttttctgatcgtttgctctttgattcagttgtttattttctcatcgtggagttttaagaaatatgtatatatatatacacatacatatacacatatgtacatatatctgtacacgcacacacacacacacacacacacacacacacacactctaaaaaaaaattagagacaaggtcttctctgtcgcccaggctggagtgcagtggtgagatcacagctcacagcagcctcaacaggtgtgagccactatgctggcctgcatatttcaaatacaatccttaatcagatatggaatttgcaaatatttcctcccattctgtgacttgtcttctcattctcttaacagtgtcttttgtagacttttcaaattttagtgatgcccaacttaccaatttttttttcttttacgcatcatgcttttggtgttctagctacacagtcattaccaaacccaaggtcatctagattttctatgttatcttctaagagtttttatagttttgccttttacatttgggggtatgttctattttaagttaatttttgtgaaagataaaaagcctagttttttttttttttttggcatatgggtgtccagttgttccagcaccacttgttaaaaaggatgaattgcctttgctcctttgtgaaagattagttaagtatatttgtgtgaattcctactgccttttaattaaaattttgggtactgtttatggggaatgctggtagtatttgttgcaagcagattcttgttttcccctccctccagtcaataactgaaaataagtgtttgcaacacacacacgcgcacacacgcacatggctagtgcagtgggtttctgtgtaaatcactgtggacccctcgccctgttatcctttagctttctcagaatacactacctccttgccgctctactttatttccttgttttctcccaccttataggactgcacatttgaaaaatcgttgaaacagattaaataacacagtctaattatcacccacctacagtccatctagtatttcaaaaagaggaattttggtgatttcacgataaatgtaggcggtctctcttcctgtcttaggtcttacagtgtcctttggggtcctgtgagtctatgataaaagatattgactctttacgggtaataagggtggtgggattatggggatattgtcaaacagtcaagatgaattctcagctcttttgcattgtcaattacaggagctcagctgtaaatcctggccacactgggctccagtttgaaagtgaggatttccaccactttcccatactttaaaagactggcatctgccaagtaatcaaaacacacaaagaggccttttaaccaagtttagcttggaatttccaactgctaaccacaagcaggtctggcaagctaggaggctggttggctgcgcagctactccagagtgtgcggtagccgagggctgcgtccgcgtaaagcccagagctgtaatgatgtcaacttgttatttactttccaaatctgaatgactgagcaaggcgaaaggagaatcaatcaaccacaatgtgaccctacaggcggaaaaaacgcagcactcccaccagcaggcggtgggggaagggaagcacgtgtagccagggcagggttgcatcatgagctcgttcgggttttctattgcacccttcgtttttctattgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtgtaagtgtgtatttttttattgatgtcctctaatgatggtgtagcaacagtcgttttgcatcattgacgttttacagcaatattttgcagggtaattttgaggtccgccgttttggtggaggaccggcctcttaaaaactcacctccggccgggcacggtggctcacgcctgtaatcccagcactttgggaggccgaggccggcggattgcctgaggtcaggagttcagaccagtctggccaatatggtgaaaccccgtctctactaaaaatacaaaaaaaattagctgggcgtggtggcatgcgcctgtaatcccagctactcgggaggctgaggcaggggaattgcttgaaccagggtggtggaggttgcaatgagccgacagcgcgccactgcactccagcttgggcgacagagcgagactcctcagaaaaacaaaaacaaaaacaaaaaaacaaaaacctcaccttaggtccccctccccctacaaccagaacaacaaatggtctagagttcgaggaagagcaagtgaggttatagtttagattgctgagtgtaccgggctcttagcacgaagctcattatatagtaaaggaaggggcaagaatatttgaaaaatattcaacgaggctgaccccagaggtgctggggagggggagtggagatctgtttaactgaattaaggctgcgagtggttgggagtagcctacgtggaggggaggaaggagcgctggggacttaggtacaccggggccaggccgtgtaagccattgcaacataaagcactttgcaagggccagagggctgatgcctggggggttggggtgggagtgatgaggcccgagtgcccaggtccccccaacctcctcagcccccacacccgagttcctggcgcctatgcctgtgtgtctgagtttgtccctaagcatttctggctcttcttgggaggtgttttgcaaaggtcgaggctccgccggaacccccactttttgagctggggtaaagactactggggtgtcttctaagacgccgattttgagggagattcaccatcgggcaggtggcagggggttctgttggggcagccgggtggcttcctttttggggtgggggagggtaacactttagcagtgatcgaggttcccctgccccctagaaactgagggggtggccgaggttcccgtcccctcgaggcagtcgtggaaaggctgggtttgggatgtgatgggggtagccctggggtcctctcagtcccacggaggccacggggaagggaccgggaccagagcaactagggagaggcccgggttcccctcacccaccctaggcgtgggggagcggggcgggcttggtagggacgctggtcccccgaccgtgggacaggggctgggttgggacgcgggtccccactaggagccgcgggggaggggcagggccggagtccctaccctcgtaggggaggggctggttcgggacgcggctcccccggggcgcaggggcggggccgggtggtacgccgggtcccctcccacggccgtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagagaacttggtgggtgtgctttcttcctctcgctctggaactcttgggcccacgttgactgaatgactgaagacagagctctgtattttctccagaaggaagtaccttgagcctctgtttaggattgctgtgtgagatagggagctgggagcagaacgcagtgacatggcagtcacagcagccgcctgctgttctgaaaggtggttctgtccagggatcatgttttttagtgtgtttccttttcattctttatttcaggctggctgttggagaaagacaaagcaaatgaatgttctctcatcagcggattggttgaccgggagtttgagttcccgaattacccccgagtaatttgcagaacctaacaggatggggtgactttggacatggacgtctgcatggtgcaaaccaacatgtggcaaacatttattgacatttgctctgtgcatgtcttcatttatgctgctttaattaattaggtggctgttaaataatgtaattagtgaatggatattgctatcggcattctatgaaggaggctgtagattccgagaggcgaagagatggccttactcttagtctaaggtttcactttgcagatgagtcccagacaaagtcacggtgtcatttccctctaatcctgcttgttccgcactaggacaaagcagatggctaggggcgtagaggcttctgtggtgattccctgggaaagatccaagtgtgcctgtgaccttcactgatgatccggacttttgcaggaaccaaatcccaaattcaagtcttgaattggcaactgaagactgaatattatatgagcagttgtcacctttagagaaaaacttaccctatcttccggtgttttctggggttcaccttctcattttcatttttctctttagcccctgccaagtggagcaagtgtgttgccaggtggtggatttggggcaccctgaggggtactgcagaaccctgggacagctcgggaagaaccgcatggaaacagtgggcagacaacaaagcatgcggcagttcccaggataaatgcacgtgtggcgggtggctttggtggctcccctaagaatgccgttgacgtatgactggctctaagtgggtttctttgtgatatagaggaaagttgattgggaccacgattgccagaatttatataacttaaatcttcagatggatggaacccttccccgcagtgcgtctcaaaaggttcccccagtccattgaagctcctcctttattttaggaatctaagtttcaactcactaaacagagatctcgcttttttttttaaattgccccatcttggtgctgtttcaaaaggatatcagagaacattattcatgttcacagaaagctctctgcacaagttctgtctggaagctggctgttgatgatggctgtctggtggaaacctggaagtcccttgtgaagtacaggaaaagggtaggagggggaggagaacagatttatgcccttaaaaaagatgtctgagccagtttttgtccagtctgggtcctttgtctctgaagtgtctcatccacagcacggtaagtaaggcaagaagttcagtctggagaatagagaaggaacagtgggttcggggaggaggatgttgtctgtaggaccacccttcagctagaatgtgaagcaaatgctctggagaatggacgctttggttaggaacagttatccttatgcaaaaggtacttatcttgagacactgtgggaaacaaacagctgggtgtatgcgttcttccgtaaaaacatacctgcacgtgatgatatcttactgtgaaatgggggaaattagtaggctactaaaaagttttttaccctgagcaacatggtgagaccctcatctctacataaaaattagctgggcatggtggcgagtgcctgtgatctcagctacttgggaggctgaagatcacttgagcccagaaaatcgaggctgcaacgaaccatgatggcgccactgcactccagcctgggtgacacagcaagaccctgtcttcctctttttttttttttttttttttttgagacagggtcttgctctgtcaccgagggtggactgcagtggtgctatcctggttcaccgtagcctctgcctcccaggctcaagcaattctagtgtctcagcctcccaagtagctgggatacaggtgtgtgccaccatgcccagctaatttttgtatgtttagtagagatggttttttgccagcttggccaggctggtcttgaactcctggcctcaagtgatccacccacctcagcctttcaaagtactaagattaaaggtgtgagccaccgtgccccgctgaccctgtctcttaaaagaaattgatggtgggattgataaactggccagtaaattaaaatcaagtgaaagctatctgatgggaagagtctcccctttccacccaaactctgctcccagctacacctctgttgttgcctccttgtcacaggccaacccaaactcctggctgtagatcctagttccttctcacttcttcaagaactttccttccatcatcatcatcgctttctctccactggatcattcctgtagcaccccaaggtacttgagcacctgccatctttaaacggtaacagaacaagcacatcccctgcagtaaccagccttacagggaagtcactcagaaccaaggctggccatcatctcagttcatcatttgtttgctcagttgtctcctcattccctagattgccttaatacacatcctgatgataatgtttctgtccccagtacctaggcctggcccagtgcctcaccctctcactcagctcagctcaccaggttaaagacatatgcatgagtatcagctggtgatgcctggtgccccatctgggagtccttatcttggctggatactcagatctcagggttcttgtttgaaagcttcagaacctgactctagctaatgtaagcccaaaggaatgaatgagccagatattgggcagctttaagaaactggagaactgggctcagaggccaaacagacaggaaccgccaagagcaggctgcaggactaggctcatgaagatgacagagatggaactgggtgctgcccacaccccgatactggatgctgcccacaccccgatactggatgctggactggccctggaggcacacccaatgctacctgccaaagtgggcctgcctgctgccaaggcttcagaagtgtttctctgcagtccattccctgaggcacaagcttctaacatgtaagacatgcctgattggctctgtcaggtcacgtgccttgctctagctgcaagggaggctggaaaagccagcagctggcctctttggtttttgaatggggtggtgggactgcctcatcaggtaagaggggatcctcaaacagaggaagggcttctgatcctgagggagagggcagacagaatggcactactgagctgaaggatgcagattcccctagaaaatctaaaacttcacatctccttgatacctttgatcaacgtcagtgtggcctagcccaggctcgtcctgggaaagtgaagcaatggttatccagagagctgggacagccctgggcagacactacctcatggtgtgttcacaatccatctacagccttgttgacttcagacgtgcaaatgcagaaccttgctggactcttgtagaagaaaaggagtcctaatcttgatatgaagcgaggtgtcacatggcagagctgtctgcagtgtcctgagaagatagtgtgtcttgcttttctatatacatgctggtggattgtaatccccctgcatgctgcaacattttggggagggaaaaaaaaagcttcaaaaagttcatggacatacatattatggaaaaactatacatggatttcaaaaatgtcttgcctcaaaataaactcatactaatttgttagaacctctcttaacaggatctagtttgaggcactaagaatgataagatatcaacctgaaaagagcctctatcagagcaacataaattgttaaaattgaaacaagaacaagcatcaaatttatggtgaagtttgaatggacttgatgaatagtttatgggcacagtgccctaaagacatcagtttacaaatggtggataactcattttaagaatggatgagatgatgttgaagatgaagcccaccatggcaaaccatccacatcaagttgtgatgaaaaaatttatcttgttcatgccctaattgaagaggaccagcaattaacagtacagacagacaatagccaacaccgtagacatctcaactggttaagcttatgtaattctgactgaaacattaaaattgagcaaattttgcactctatgggtgccaaaactgttgcacccaggtcagctgcagacaagagctgagcttttgatggaaattttaaccaaatgggatcaagatcctgaagcatttctttgaagaattgtaacaggagatgaagcatggatttcccattaccatcctgaagacaaagcacaatcaaagcaatgactaccaggaggcaaaagtagtccagtcaaggcaaagcagactggccaagaccagaggtcagagcaacagtttttcaggatgctcaaggcattttgcttgttgactttctggagggccaaagaacagtaacatcttattatgagaatgttttgagaaaattagccaaagctttagcagaaaaatgtcctggaaagctttgccagggagtccaccacagcaatgcttccgctcattcctctcatcaaatgggcaattctgcaagagtttcggtgggaaatcattagacatccaccttacagtcctgatttgcctccttctgacttatttttctttcctaatccttaaagggcacccatttttcttcagttaatagtgtaaaaaagactgcactgacatggttaaattcccaggaccctcggttctttagggatggactacatggctggtgtcatcacttacaaagtatcttgaccttgatggagcctatgttgagaaatagcgtttgttttttatcttttcatttcatttttcaatgaactttttgaagttccctcatatatcttaactgatggaaatatgggcattagtcaggttccaagtattccttagactatgtcattactcaacacagcatgaagctcaattcctgagcaaagtcatgctgtcttctctgccccctagtgtgtgttaggaggccaggctgtgctgctgctccacggggccctggttccctattcatcctgctgcatctctaccttgctgctgtttggcatcatcaataagcttagtcaagagcatttcctctagaaatcacatctttactgcaccttttctatgtttaggtatgtttagatacaaaactaccactgtggtacagttgtctacagtatttggtacagtcacatgatgttcaggtttgtagcataggagccataggctctaccgtatagcataagtgtgctgtagcctgtaccatctaggtttgtgtaactgtgctctatggtattcacacaacagtgataccacctagcgatatatttctcagaactcatccccatcattaagcaatgcataactgtacatgtatttattttcttttgctagaagtgttaagacagaatccaagtcaggctgagagctcagtcataactattttatttaactacttccccaaggatgtggaccttacacttactttacagccagcctcagaaaacttcctagtggcaactaaggctagagcagctgtagagtggtctggagggggctcttccattctcacacgtgtgtgcatgaaccctttctcctatcctaaaggcccttcgggaagaagctctagctggtgatgagagcaaggtttgggggccgctacacttcggcagtgcagtgttgggaaggtgagaacacagttctaaagaacaagaattgttgagtctgaggaatatggggtctggacccccagcacatccccttcataggtctccatgggttgggagagcagggtcaccctcatttttgttgcaggattcacttgcagtgtgaatttcaattgtgctggcatcagaacctggagaggaaaagacaaaagactgactgtgtctgtgtcctagcaggtttgtcatcagcttcagaaaatgctcagtattcagtgcatggagtttttcatggaccaactttggtcaaagtcctagcattcatctcatctgcaaaaaaaaaaaaaaaaaaaaaaaaaggtgggaggggtggaaatctacatcaactttccatctacattttattaaatcattacaacggatgacacaagccctacagaatcatctaggccagttgattgataggtgactgcggcacagatgctgcaggtgacacaactgttggtttaggaagatttcagagccccaggacacgtgctgtctgatgcaggagcagaacacactcttgtgaccactggtgcagcttctactgaggatggtaactaacacaacagggaccctatggttgcctggctacctacactcaattctaggaagtgcccaaagggagggagaccaccgctctgtaaaactatgccatctcccaattgtcttttcatggacgatgccatatggtttcagcaagtagctcctccctgtcagcatctaactctactcatggaaaactcatctctcaatgcccaactaaatacacagtagtacatgcctggtaactctgtcaaattgggctcattttttctgattgtgaccctagatatgatgataaagtgatgaatgatatttttgtaaataccagaatatatttgtccaaatatgctcagcattcccttcatgagaaatcgctggagacatttttctcaggcctggatttcatggcagtttgcttccgtgcccaatgttttcttttaaatcatgaagaatcttgtaactggtcacatttttctctttactccccatttagaaagcccaaagccaaactactaatccattttaactatgtggggctaattctacctggctttcttttgatttcattatttcctttggtcctgttttctttatttgttaatcaatcttcccctttctcctgtccttccagaatgtgacaagatttacaaaaagcagacacaatacaaagagggagaaaaacgtaggcagcaatcagcagtatgaaagttaacatcactcccatcgaaagagtaatcctggatgtcagtcatcattctgatagtgacaggaggcagccaaatgcctaggcagataggagtgggtccctggtttggggtttcgaccccaccttcaagccaaaaacagcctgaagtctgaaagactggactgctggtaacggatgaaatccacaacccaaagggagaacctctgttcctgccctttctcaattgattctttctgaataatgccttttaaccaatcgaacattgccttttccagtactacctaaggcctgctcctccccgattctgagcccataaaagccccagactcagccatattagggaaactttcccaccttctggtagggggaccacccctgtgtcccctttctgctgaaagcagtttcatcactcaaaactccctgccttgctcactcttctatagtcagtgcatcctcattcttcttgggcatgggacaagaacttgagaactggtgtgcaagccagacttggcccatgcaagctgggtgggcaggccatctcctgcaacaggtagcatggccgagcgaggcctgggcggggcatcaccagccagaggtccccagcttgcaaagtgaccaagaataaaatcctgcatcaattccagcaacatgtcttccttcagaatctgtgagaccctttggaaccaatgtcagaattattcttccaatccccaaatatcctagagtacttgctccagccgcaacacaggttatgggctttcacatggggaatacacaggtggaagacacaacagagagtggccttcctaacaacagatggggcaagtgactgcactccaaaaagcctccaaagccctccacccatgggccttgctgacaactgcagcttactctgtgttcctctcagctccctcacacccttaagcacactgcctctctccctctcactccaggcttggtcctgccacagggcattggtgcctctctttttctgcctgtaaagctcttctgattttctcatggctcctacagttcattaaggtctcaattctaatattacgtcatgctcaggaagactctcaggacaccctctctaaaaccatgctcctacctcctccctgatttttcttcatggcacgtcccactacctggctggaatatgatgtcattatttgtgtttttctttctgtctctgccactagagtggagtctcagtggacagggaatgtgtcttggtcaccatagtgtacctaatgccccagacaacacctggcatgtagagggtgcccaataaacatggggaatgggtcagtacagtcacataggtgccttgacagcaacgggatgcagcactagtaccttggagcactcattaagacatgagtataaagaaaagggcaggaacaagcacaattttaaaagagatacatgcagagtttgagaggacatgttaaggaacaaaaaaaaaaaaaattagagttatatagaaaagaggaagtgagaaactgtgacatcaggagagatgtacttggaaaggattagggaagcctgagctacagcaagagatgacaatattaccaagaaggcaagtgtgggctgggcacgatggctccagctgtaaccctagcactttgggagaccgagtcaggaggagtgcttgagtgtgagaccagcctgggcaacatagaccctatctcttaaaaaaaaaaaaaaaaaaaaaaaaaaaaaaaggcatgattgcgtgtgcctgtggttccagctacttgggaggctgaggtggaaggatctcttaagcccaggagtttgaagctgcagtgagccatgatcatgccactgcactccagcctgggcaacagagtgagatcccacctcaaaaaaaaaggcaagtgcaatattgtggtgttcctccaacacatacacatgcacctgcccacacacacacaagcactgtgggctgtgggaggacacgacactcagatcttcctcccaggtttggattaagatgagtcctggataatcttggtctgagtaactcagatcaagtgtgatgagctgcttgaagggcaggtaaagggattcaaggatgtggggaggatggatctggccgtagatcgcccagccagatcctgaggagagtctgggtagccgacaaggatggtggagagggtggttttgtcagtgtggtgaatctgctttttctggagcccagacaccagctgggaaaacttctaaaggagccttccagttccggagcaacattcttgctggaagggggctggtggcacttcaaaaatacttgattctaacagggtcacacactgtttatgaggacatctggattcatgggaactcctttgtgatttctgtggttcttttcaaatagactctgggctgggatgtcacatggtggcttgtgatcaaggtctggactgaggacactcccccgtgacctcacactctgggacatgttctgggtcctgtggctttgaagaatttctagtgctttcatcctctccctagggctccatggaagagaatatttatgcatgacaactttcttgaagtaaattctgctgggagggagctgcccaagttcagcctgcctgtgctcagctcaatgagtgctttccagcagccttgaatttccaagggtttctctgctggtcttaaaggtctctgtgagcagggaacgtgctggctgagcaagtctctgagaagataattcaaccaggctgttggaagatgttgactaattcccaattgttgcaaaatctgtgaagatctaacgtccctgcaggaaatgcacgtcccagtgacctcatggtacccaagggccaacccccttccaactggccctctttaatgagccttgcaagtccaggtaggttgtttggattctctcagccccatgcagatctgagatttggacatacagccatgcaccacataataaccttttggtcaacaacattccacatatatgacagtggtcccataagattataatactgcatttttactgtcccttttttatatttagccatgtttatatatacaagtattactgtgctacagttgcctacagtattcagtgcagtaacatgctttacaggtctgtagcttaggagcaagaggctgtaccatctagcccaggtgtgtagttgggtataccctctaggtttgtttaaactctatggtgttcacacagcaatgaaattgcctaacatgcatttctcagaatgtatcctcatcgttaagtgttgcatgactgtatattggatgtcccttgtgccctcaactgcctttctcagatcccctgaaatctttgaagtcctagaactgaaaccccaaccagtgggcactgagcatgaaccatagaaaacatgacacctggcccaactccacttcaaggtgttaaatttgatctcgccagctcaacaaagtccaaggccctagggtattttctcttccacaccctcaaagcaactacagttgatgaagacaccacgtgttacttttagggagaggggaaggtaacagcagaccactgaggggaaagctgatctcccagagcccaagctgagacttcacctgagctgggtgggttttgcagaggagtggaataatgtccaattcttgggcagtgtctcagggtgctacttggagaacaggctgctgaaaaaattctgtgtatgcatggtgctaggtaaggggccttgccattgggaggtggctggtctaacagcttactagaaattttgcaaattatggaggggaagagaagtccaggctaacatgatggcttttcagaggcagtgaaaagaagcagccttgaaaggcagccactgagtgccccaaaggctcttgtttgaagcatgactcctcctgttccagaaaagggtctgtccctcacaggtactcctgccttccctaccttcctccatatgcccacatttatctctacagcttacttgtggaaacaagccccaactggtccaaagcaccccactctctcccactcacttgttgctgtcagtatttgaatgaatcagcagggttccactgaaactatgagagggtaacaggcacgggaaggggaagggctggggctttgggtgtttgctgtcttgaaagaagtgctctgagagaatacttatttatatttcaaaagctggattttaataacctactaaaacagaggcctgttgggatatggaatttaaaaaataaaaaagcttgaggtcaggaattcaagactagcctagccaaaatggggaaaccacatctctacgaaaaatacaaaaaaagtagctggaacttagggagcctgaggcaggagaatcgcttgagcccaggaggcagaggttgcagtgagctgaaatcatgctactgcactccagcctgggcaacagagcaagactctgtctcaaaaaaaaaaagggaaggagaatcttagaagagaaacagtggagatgtacaagaatgatggagaaatatggaagataatggaaaagtgcggaagggaacagaatttggagggagagccaagaattatgggaaaggacagactcatggggaaaaaatggtggaaaactgggacttacaagagaaaaagaattatgggaaagatagggtattgtgggagagaacagaaaaatgtagaaaaaaataagaattttagtgagaatgaggcactatgggacagaaagggaatttggggagagccagggaagtgtgaggaatacaaaacatcatgggagaaaatggaattgtaggagggaacagagatttgtgagagagaacagagaacagagaattgtgagagagaatagggaattgtgggcaatataaggaattggggggggggggaaggaattgtggaaggcaagatactgtggaaaagagaactgtgccaggcacaaaggattaatgggaaagactagagagttatgggaaagtgatgaaattgtgagaaaggtcaggaattgtggaggaaaatgttgaatttggggagagaaattatggcagaaaatgaaaaattgaaaaagaactgcatgtgagacaatttaatagagagtagaattatagaaaaagagatctgtgaaagataagaataaaaaattgtaggagaaatagagaatttgtggcaaagacaaagattattggataaatggggacttaagagagaaacggaactgtgggagagaccagagaaccatgggaaagacagagattgtgagatgaatagggaattatgggaggaaacagaggattgtaggaatgaccaaaattgtgggagaaataaggaattctgggagagcagggaattgtgtgaaggacaggaactgtggagaacagagttgtgggagaaacaaagaagtatgggaaaacaaggcattgtgggaaagacagaccggtaagaaacatacaggactatgggtgggaatagagaattgtgggaaagagctgcaattgtgggaaaagcaggaaatggcgggagagaatactgtatcttgggagaaaaggaattatggtgcagaattagttgtaggagaaatggaattacagggcagagagaatatggtatagagagaatacaattacaaaagaaagatttctgaaatagaaaaatggagaattggctgggcacggtgactcacacctataatcccagcactttgggaagccgaagtgggcagatcacttgaggtcgggagtttgaaactagcctggccaacatggtgaaaccccatctctactaaaaatacaaaaattagccaggcatggtggtgtgcacctgtagtcccagctactccggaggctgaggcacaagaatcacttgagcccaagaggtggaggttgcagtgagccgagatcgtgccgctgcactcagccttggcgacagagtgaatgaaactccatctcaaaaaaaaaaaaaaaaaaaaagaatggcaaattctgagagaaagaagagacgagtgggaaagaagaaattgttagagaaatatggtacagtgggagaaacaggaaattcctggagaaagacaaggattgtgggagacaaaaggaattatgggagactcaagatatcatgggagacacaaggcattatggaaaattctgaagctttatcgtgggagaaaaaaggaatcgtgggaaagatggggattgtgggagaaagaaattgtgggagaaagaaacaggaaattgctggagaaaggcaaggattgtggcagacgaaaggaattgtgggagacgcaaggtattatgggaaatgcaaggcattatagaaaattgtgaagccgtattgtgggagaaaaaaggaatcatgggaaagatggaggttgtgggagactgaaggtactatgggagaaacacagaattgcgggaaagacaaggcttgtgggagattccaggtattatgggagatgcaaggcatttatggaaaaccatgaagccatattgtgggagaaaatagtaattgtgggaaagatggggattgtgggagactcaaggtactgtgtaacagaattgtgggaaagacaaggcttgtgcgagattccaggtattatggaagattcacggcattatgaaaaattgtaaaaagggattgtgggagaaacaaggaattgtgggaaagattgggattgtgggggactcaaggtagtgtgagaaagagaactgtggaaaaaaagaaaggattattgggaagaatggagaattatgggaaagaagaggaattgagggacaggcagggaattgtggtagagaatggagacttgtgggagagaacaaattagagtggagaatggagaactgtaggagagacagattgtggtagaaaatagattatagaagaggcctgatgcagtggctcacgcctgtaatcccaacactttgggaggccgaggcgggcagatcacaaagtcaggagttccagaccagcctggccaacctggtgaaactccgtctctactaaaaatacaaaaattagctgggcgtagtggtgggtgcctataatcccagctactcaggaggctgaggcaggagaatcatttgaacccaggaggcagaggttgtggtgagcttagatcgcgccattgcactccagtctgggcaacaacagcgaaactctgtctcaaaaaaaaaaaaaaaaagaagaagaataaaatagattatagaagaaaacagattttcaagaaaaaatagaatggagaattgtgggagaaaacaattgttaggagaatgttattgtgagagaaatagggaattatgagagaaaaaagaattgtgggagagacaggggactgtggggaagaatgccaaattatgggagagccatggaactctgggagaaatacagaatcggggaaaatacagggtattgtgggagatacacggaattgtgggagagacagagaattatgggagaaacagaattgtggagagtagagaggattgatggtcaaaccaagaatggcggggtgggtgtcatatggaattgggggagataaaaggcattgtgggagatacagctacgctcctttctggccatgtttctgggctctgaatgggcctcaccccacctgtgtgggaacacagcccctctgttctatcctaaccacgacccctccactcccaacaagccctaagcctcagcctcaccggcctgggcttctccccgggatgatccttaaatcttgcaagtttgtgtactagcacactcgtcttccaggaaagatctatactcctgctcccatcagaaatgccctgctcttagtagccacatccctcctgccagactctgccccttcgctctcaccaggccctaccccaaaacacagccccggccaggctctataagctccacccagtccccacccctcctgccaggccatgcccccctggctcgctccctggagggaaaccgggaggtaccaaggggctgggtctcctgagagccagcgcaggcccgggagttgggtgcctgcacatctagggagtcaaaagcggttcaggtgcacaatcctcccctagtaatgactctcttcaggattgtcccagatcccaacacctcgacttgatgagcagagagtgttcagcaaggaggcacaatggtgacggggcgtggaaccgagctccatccagcggctctccgcctccctaagcggagacacagatcccctcaatggaaactgctgccacaatcacaaaacgcgatgcattacgtgttttcttccacgcccatgcactgggctggtcctacaagcaaattgcagtgtctctccacttaaaaaccttaactggcctttcgctggccaccggataaagcccaaacgccctagcagaatctttataaacccttcaccacttctccagcttcccccaacgcctccataccacgctgagccacaaccgtccccaaacaagacgcagactttctatgctaactctcaacaccgcgtcttcctcatctagattttctgtctcctctttgcctatgctgttctatcatctaagacccagcccgcacatcaccttctccaggaactctcaccagtgttccaaaaccaacttagtcctgcattgcctgtgttcctttaacccttcacaggtttaaaaaaaaaaacagtattgtccttacttacttgggagtttcacaaattatacttctcaggaacactcacccatcccggctaaaatggtgttgaatatttgcttaagacaaaattcagttaacttgtgtgaagtacctagtaagttccagacaccatatcagatacttaataaagctccatgccagcctattggtcttgtagtgaaacccgaagcagtagggtctgaagggtatgatgaacaagttgagctttatatccactgtctacatagggagaagcccatggctaagttttttctgtatctgccatcgtagtaatcaggtgcagccaataggaaagcagccctggtaaggggttttccttgactttacgcacagaagtagtatccgatgcacacttaacttacccaaattcacctctacttagtgaggggctggggaggtatggcagggagagtaggtgaggatttacatagtcccagggatcctgctgcctgcaagctggtaaagctctggtaggaaaatcggaatgacacctgcgtttcccccgccactgacagaagggaagcacattctggggtgacaggcaagtggccccagagacataccgaccaggaaagatttagaagggatcctaaaattgtccccaaacaatacaatggtgatgagagccaaaagtccgatgtggaaatattaaaaaatgtgaggtgtcctaggcagcaaattaatttctgaataaaagccttttcaattctttttagattaatgtatgcaaattcctgcatagggttaccatacaaaatggtgatgactgcatgttatgggcaattttaagatattcaaagggtgactagatgtaaacttatgaccctaaccaccacctcagtagcaccgccactttatacttttttttaaagagatggggtctcactatgttgcccagtctggactccaactcctggcctcaaacgatcctccttcctcagcctcctgagtagctggggatacaggttcatactaccaggccaggccactttatacttttgcagatgtttgttgttaattctgaaaactcactctatgcttcaagctctatcctcaaaaaccctgacagatgttacctaataatatgtcacttggagttctaaattggcagctgccatttttacaggaattcttcccacaataaaaaaataccgattgtatttctcatttttctcaaaaggctttccttttgttctttccttttcctccagtgttttctccaattggtatttccattgagtgttctattgttagaatagaatgattttttaaaatattttaattttctccaatagactgtgagatccttgagggccaggtttacacatctccagtatctccaccccactcagctcctagtacacagcctggtagagtttggggcagtcataagtagttattaacagaataagagtgggccaggtgcagtggctcaggcctataatcctagcactttgggaggccaaggtgggaggatcatttacaagagtttaagaccaatctgggcaacatagggagaccccagctctataaaataaattttaaaaacacacacacaaaaccaaagaaaattagcagggtgtgttggcacctgcttgttgtcctagctactcaggaggctgaggtggaaagatagcttgagcccaggagatcaaggctgcagtgagccatgttcattccactgcacttcagcctggacaacagagtgagaccctgtctcaaaaataaataaataaaacaaagaataggtgtatccatacaacgaaatattatcaatccataaaaagaatgaagttctgacacctgctacaacatgggcgaatctagaaaacactatccgaagtacaagaaaccagacacaacaggacgaatattacacaatgccctttccatgtaaggtctggaacagcaaagccatagagacagaaaggagattcatggttgccaggggctggggagaagagaagggaaatgactccctgggggcacagggtttctttctgcaacgatgaacatgttctgacttagatagtggtgacgtgtgcacaaccactgaaatgtgccatttaaaggggtgacctttatggtacgttaattatatctgaaattttttaaaaagccaagggaccaggtgcagtggctcaagcctattatcccagcactttgggaggccgatgcaggaggaccacttgagactagcctgggcaacataatgggacctcgtgtctccaaacactaaaaaataaaataaactaggcatggtggtgtgcacctgtagtcccagctactcaggagactcaggtgggaggattgcttgagcccagaaggtggaggctgcagtgagacgtgttccttccgctacactctagcctggatgacagagggagaccctgtctcaaaaaacaaaaacagggagccctcacagagagcagcctccagggatggctgccctgcttatttttctattggatctgtatttgctttttctaaaacctctatgtgaaaacatccaacctttgagcagaagatctatgcaacagcttgccggagggagtggaagtaaggaaatgctgatggattttgtttggtggtggtgattggggtggggtgcaggggacttttactgttatttctagtgttttatttgactgtcaaatatctgctcagccactttaaaacagcaggatgggaatgcaaagccaaataattcaagataacattttttgcttcattccctagatggtatcagtaactctacagactaacagcagttccagctggtgggtccctcatgcttcgtgaactatttgtaccagacggaaagtctgtaaataaatcttctctctgtgtcttttagcttcagccagaactatctctttctcttcatggctcccaatttcaaccagacagtacggtatcatggaatcaattcatcagttcatcaccatattttttggtcttcaaagtaaaccaagcttgtcacctgaaagtgaaacttccttcaatgtatttgtttgtttttgtttttgttttgttttttagacggggcttcactcttgttgccccagctggagtgcaatggcgcgatctcagctgactgcaacctcctcctcccaggtacaagtgattctcctgcctcagcctcccaagtagctgtgattacaggtgtgtgcctccatgccggctaattttgtatttttcgtagcgacgggttttcaccatgttggtcaggctggtctcgaattcctgacctcaggtgatccgcccaccttggcctcccaaacctgctggcattacaggcatgagcctccacacccagctatttttgtatttttagtagagatggagtttcaccatgttggtcaagctcgtctctaactcctgacctcaagtgatccacctgccttggcctcccttcagtgtatttgaatagtaggaatggaaaagaaaacggaactccttaagccatttccaaacatctttctgcatattatttttcttactccaaatttcaacattattttggtacaccccatcacgggattgtgtggtgtttgtctttggttttgtgtttgtgtgcatttagctcagacaacatctggaaaaaaatcacatttttagatccaagcctaattattctgagacactggttgtgaactgggggccactgtggctccccaggagacatttgtcaatgtctagaaagagttttggttgtcacaattggggaggtgcaactggaagctagtgagttcacatgagaggtgctgctgaacaccccgccatgcacaggacagcccccgggacaaagaatcctctaaggctttccaaggggagccctgggaccccgaagtctacctgctgtggcagacagggcattaccttcagacagcatgctcagggcttcgtcagaagtctgcccacccacttgagacaccttcccggaagcagggttttcatggggcatcagtggggatgggtgagccccctcagcagccgaggtggtcagtgattcccactggatctccttcctgggagactgaaaacccaggctgcatcctgtccagccgtagaaggccaaagacaagagaaatccctgggctggattcaggattccctggagagaggacagaaagacacatggcagtcagtgcagcgtagcagaagtcagagccctgggctgtcacagagtgacacactccccccaggatgcccacagggctggactcgcttggaagggaccatgggttggctggtggctggttgactggttggtgggttggtttggggcaagatgaagattggccacagtaggtgctgtaccttcaagggtgcctgaaagcagaggggagtggggagaggaggggacggggaggagctggagtagagaagggaagaaaggggacagaggacaagagagaggagggaagacaggagaaggagaaagtgggaggagagggtgggggaggagaagagggcagcagtgggagaaggggagagggagcgctgtagcacagggactgaacagccagctcctcctgcagcctgggggcctctgttctccccagtttgccaccctgtgctgccaagggagcacttgatgtaataaaggttcctgaggctcagacggagtctgggaaacatccctccactcttgtgtgctaaggacacataaagttcaccagaggaacccagccaagctccaaaccacgtgcagggatggaaggaccggtgctggctccatttgaaagtctttgtaaatgagactttccccatttcaaaagcaatataaatatggattctgtatagtacaatatgcacctccctgccaacaacacgtgtgcatttcttcttataaaggtgagagaatggcagcactggggcaacttgcccatggggcttctaccccatcattctcttcatgtatgtccatccaatacatgaattttttttctgtttcatttcttgtgttttttcattgtttccccgttgaaaaaagataaacatgtttttctgtacttgtaattggtataattgtatatatttgatttcccagttaataccagagatttcataatcatcatttttaacatctgagtaatagtccatcaagatgaaagaccataatttacttaaacatttctttctttcttttttttttttttttttggaactccaggttgcctataatgctttacaattatgaaggataatgctaccaggaatatcttcatctgtgtggctttttcatggtctgaagcattccttcaagatccatgctctgatattgtgagactgccaggagctttgatacactgcaccaaactgtttgaccagagttgaagcatttaataaggatcccgacaacaaacaaaacagccagctagcacactaaggccaggagcctattttgctcatcctgtatttaaatataatatattgtacttctgactgcttctttttcttctgattttttttcaagcagaaagtgttaaatatagataattaaaaaaagagatggggtctccctacattgcccagggtggaggcatacacctgtagtcccagttactcaggaggccaagacagaggattgcttgagcccaggagtttaaggctgcagtgagctatgatcatgccaccgctttccagcctgggtgacagagtgagaccttgtctctgaagcaaattaattaaataattaactaattaaaataaaatatagattgacctaccataataaaccatgtggtcttggctgcagttctgacaggtttcaaagaacctccattgatatctgtttgcatctcaagatagaataaaaggctttcattgatgatattcgacaaccaactgttagaaagaaaatggcagcaggtaaagagaacatgcaatgaaactcgtttttaaatgctggagagtcagagaagaatttctaccaagacctaaaagtaccaactcccggtatagacatggccacttctgcagtaagaaactaagagggccaggtgcaatggctccctcctgtaatcccagcactttgggaggctgaggcaggaggattgcttgagcccaggagtctgagaccagcctgggcaacacagtgaaatttgtctctactaaaaataaaaaataaaaaaattaaccaggtgtggtggtgtgcacctgtagtcccagctaattgggaggctggggtgggaggatcgcttgagcccaggaaatcgagcctgcagtgagctatgaatgtgccactgcactccagcctgggggacaaagtgagaccctgtctcagaaagaaaaagaaaagaaatgagactaagaggaaccagcacactaagaatttaatttaaaaaacataattcgttttctcagtctaaagcacagatcagcaaatccttccaatggtaccactcaacaccacatcagggtgtaaggttctagcactgtatcaaataacccagaattcattttttgtttgaagagcaacgtacagttttcatggagatcaaaacaattttttcttgccattttataatagtatttttcaatgttattttaggtggctcagtgaaatatgaaatgttgaactgagtgtatttttagtaggagatgatttatgtatctccaagaaaggtgtccaaacaaagctcatatcaggtgaattattattactattatgttttagagacaaggtctcgctctgtcacacaggctggagagcagtggcatgatcatagctcactgtagcctcgaactcctaggctcaagtgatcctcctgcctcagcctcccgagtagctgggactataggcatgtgccaccattcctggctaattgttgttgttgtatcgcccaggatggttttgaactcctgacctcaaggaatactcctgcctccaactaccaaagtgtgagctaccacgacccgcgcaggtgaatttttaacatcataagtacttgccctgcctgcaaggtactgattcaccacagtgcagcatgttctgattccagttttattttttgcattggttacaggtctgttttcaaagtatccacctgaaaggtttggacaggataccagtggtggggaaaaatgaggagagacaaactgctcaggccgttctccaaccttcttgaccaaagacgtgcccttgcccctctgtcaggcacaggaattctggtgtcaggagtgaggcaaatgggtgagtttataaagcatgaccagctgagtgtggtggctcacgcctgtaatcccagtactttgggaggcctagacgggtggatcacttgaggtcaggagtttgagaccagcctggccaacatggtgaaacctcaactctactaaaaatacaaaaatgagctgagtgtggtggcacacacctgtaatcccagctactcgggaggctgaggcagaagaatcacttgaacctgagaggcggaggttgcagcgagctgagatcgtgccattgcactccagcctgggtgacagagtaagactacttgggaggctgaggtgagaagatcacttgagccctaaagatcaaggttgcagtgagctgtgattgagccactgcactccagcactccagcctgggtgacagagaaagaccctgtctcaaaaaaaaaaaaaaaaaaaaaaaaagcatacgcaacccctttgttttggttaaccccagcaatgcacatggttgggacatttcaaaactaaacttgggtgttcgttttctaagggctttatatataatttgagtagatttgaatgtttttccagaaattcatgaattttggacttgctcccctgtcctctgtgcctttcctcaaagggcacctagcacagtctcaaagatttccttcccaaaggctcttccctttggaacttctggtcacgcatgcaacatggcaagttgtttccatagcccttcccactggcaataaaaatacacatatatagaagaaaggttaccaaataattaaaaccagcatgattttgaaaaatcggatcttgatcacggctcccatcctcctctcgttctccgtgtaaatgccttgtcttcctttaagtaaagaggccactgtgaagaacagaaggaactatgtatggtgttcattattcatgtttacggagtgacagagaaggcaatggaagcaggtgtgagcccacaagcaaggccagaggggcaggaagcaaagcaagtcactgacattcattcctcacaacttccaggttggagtcctcatagaccctaaggaatatacatatttttaaacttctgctttgaaataattttagatttacataaaagttgcaaagataaaagatagcacagagagtccctgtatatccctaccctttacccagattcccctcaatgtaagcatcttatgcaaccatggggatgttcttcacaactatgaaattaacacaggtacattactatgttaactcccaattttggctgggtgcagtggctcacacctgtaatctcagcacttgggaggccaaggtgggtggatcatttgaggtcaggagttcgagaccagcctggccaacatggtgaaactctgtctttactaaaaatacaaaaattatccaggcatggtggtgcacgtctgtaatcccagctatccgggaggctggtgcacgagaatcccttggactcaggaggcagagattgcagtgaggcaagatcactgcactccagcctgggtgacagagcaagactccgtctcaaaataactaaataaataaattcccaattttatttgaatgctcctagttcagaaactatatttttaaaagctcattttctctgttataaaaatagaggtgcagtggctcacaactgtaatcttagcactttgggaggctgaggcaggtggatcacctgaggtcaggagttcgaggccagcctggccaacatggtgaaaccccatctctactaaaaatgcaaaaattagctggctgtggtggcagatgcctataatcccagctactcgggaggctgaggcaggagaatcgcttgaacctgggaggcggaggtttcagtgagccgagatcacgtcaattcactccagcctgggcaaaagagcgaaaccccatctcaaaaaaataaaaatagtgcacgcttgttaaaatattgaaaaaaatttaatttcttcttatagacaagttagaaaatatttaaaagtttagagaagtatgaatgacccatggtccgtccacccagaggtaaccactgttaacatcttagtgtatttcttttcagtcttttttctataagtcatttccatcagctcaaatcactatttttgatgagattttgtcttaaaatgctatatttaacacactatatttaaatgtagatatgcgccaggcgtggtggctcacgcctgtaatcccggcactttgggaggccaaggtgggtggatcacccgaggtcaggagtttaagaccagcctggccaacatagtgaaaccccgtctctactaaaaatacaaaaaaaagtagccgggcgtggtggcgcttgcctgtagtcccagctactcaggaggctgaggcaggagaatcacttgaacatgggcagcagaggttgcagtgagccgagatcacgccactgcactccagcctggggtgacagagcgagactccgtctcaatgaaaacaaaaagtgtagatatgaagagaatggtccgaagaatcacaataatttcctattaccaatgatagagtactctcaacaatgtttttaaaaagttcaacaatcaacaggtgatcttcaaaggacctctcagttaaggcaaatttccttattcccattctccccttgagagatctctggcagcctgaggaggtgggaggctcactccaggacacacttccttgaggggaaagtaggggctggactgcaggtctccagccccagcctagaagtctttcccagacatgttgccaacgacttcattactcttatccttttctaaccattgaccttgactcatttcctgtgctccacttcctgtttcctgcccatctgagaaaaaacatcagccaagtgcattatggggctggagccgcctcagtacagactcagtcccttccccctcccttctcttctccttctgttcctctcacacctccacagtcgtccaagggcactcctgcagccgacccaggagaagcccagtacagaagtgaaaagtcaactagtcctggcactgagctaacaaacgatggtacagaacttgtgcgggcagaggcctgcacattttcatttattgaacctgcttactttctgcagctgtgttctgctgatgtctctggaggatgacaaatgaggtcaactgtcctggagaattccaggacaacatgtgtcactgtctgagcccgaggcatggggccgctcccagtggccgtgtacccagagagcttccctagtatttacctgcagtcactgtcttttggaacaggatggggttcgccacgagaaccagcagcaggggcaggtacatggtgacatagtgggggatggcgtggtccaggccccgctcacacctgagagaggaaaaccaaagtcattcttctcaaaagcaaagttttggctaaaagacatctacttatctggaagtcaagataagaggatgagaacaaaaagggaaatgcataaatctgctgctgactgcccaaaggaaatgtgagtcatttctcatgtctggaacaagccataaattgcaggagagtaagggagatcaaccatgtttctgtctcagaaatgggaggacccctaaggcattccactggaggaagcttttaaaggttcctgctgggaaaagatcggaaagaaaaacaccctgggatgggggattccctgcactgggtctcaaggaaaaaacgcaattcaagtagagacaaaggcactccattaaatagtgaggttttgagtacttactacatggttttgggcaataacatgaataaaatcttgtccctgggcttgaacaactcaaaatatgccagctgcatatttcagaggaaatgtgttctcatggttatggataacaatagtttcagaggttcttgtcagagaaaaggacaaagatttctactgaggggtcataggagtcactggtcaccacagaatgtgctggagggcctcacaaacatatgttaccaaggtaacaactctcagctgcgaaatgcttaatgtaggagagaagcaaaatggcacagaggaagaggaaactgaaggcaaaggggagggaggtctgctccagctcaaccaaagagggaggtggaaaaggggctaaccaaacagcctcatggccacggaagggggaatgacaaaaaataaattaaacacccttaatattgacggagttgtcaaaccagaggggaaagtggcagaaaatgtaaaaaaaaaaaaaaaaaaaaaaaaaaaaatcaggtgggaaaaatgcaatacccgtctcctcttgccataggaagaattactataccacctctcaacgctgccactttcttttaacaggcggttttatctttagctgtagaggctaaaattcaatctggaaaggcttgaaaggagaaagagaaacaagaggagaaagagaagtgactccgatgcaaagacagaaaggaaatgacaaataagagagtgagactgtgagcatgaagaacaccgagcgccctgggtcaggcgttgtgaaaatgaagagatgattaaggataagatgcttaaaaggtacagctcctaaagaccctgggagcacctcaaggctccctgtgcgccctgcagcaatggcaccctaaggctcagatgcaactttgccaggagtctccggggtcccacaggcgagggagagtcacagaaactccctttccaactaagtgcattccgttataacagctgctgacagtgcatctgtccttttaaagttccccagaaaagcagaatgtatggatggatctatacagagctccctgcttgtattcatggttgacaaggcaacaccaatttggagacatcctcactgagtagccgcaagaagcaagagaagagggagataaattatctacaccaatttttttctgtcgattttttttctgtaaaagaacagatagtaaatattttcagcttcatgggccacactgtggtctctgaggcaactactcaactctgatgttgtcatgcaaaagcagtcagacagtacataaagaaatgagtgtgactatattccaataaaactttatttacaaaaacggaagaacgccggatttgtcctgagggctacactgtgttgatccctggtataaaaatcacagacaaagacactgtccacttccattttccagttttccattggaagttagagtatatatccttggaaagaccttggctttgcaactgagggttgcatggacaggaatgtaaacttgaggaaatgcttgagacagttccagcggccacatctccctctgtgtggaggatagaagagaagtgagaaagcgtaggaagcaaagctagagaataagctctgcccagggatccttatggcctcttccacattatcctacactcattcctagaatgttaagctcacctgctcatccagaggaagcttgaagaccaaatacttaagagtgggcatgagaaaactgtaccaatacaggggctgggaatacaccttacgtggagggaaatatgcggaaagctttgcctacatgcttgtgtgcatgggtgcctatgcacacaaacgagaaaggcagagccagggagaatgattccagggtcattctccaagctattgtagtcagccctctggggctgggccgtgagcatggcctcatgtggccctgagacaacggcctaacctccaaggcacccactctgtgggtcggggctcatgtattccctgcaagacaacacattatgagccaaggatggggctgcctggggcgctggagtcccaacttacctggacacggaagggtagtagagcatggcggctccctccacacagagcagggtggccaggccccacgccatgatgtgatacagcaggatggtgctaggggacaagcacaacagcagccacagctcagtggggcacagaggcctgcctggaactgccaggccagctcctgcgctctggaaaggtcaggaaaatgtacacagaggaaagcccctcggcaaagagtttcctcgtgctgctgaggttggttggttgttttccattgaggtgaaattcacatcacataaaattaactattttaaagtgaacaacaaagtggcatttagtacattcacaatgctctgcagccatcaccagcgtctccttccaaaatgttttcatcattccaaaaggagaccccatatccattaattggtgatatggttaggctttgtgtctccacctgaatctcatcttgaattgtaatctccaaaatcccaagggatagaacaagttgaactaatcactgttggatggaaatcaattggttaggtggttggaggacggaaatgaccaggtggaggtaattgaatcatgggggcggtttcccccatgctgttctcgtgatagtgagtgagttctcacgagagctgatggttttataaggggatttccctccccccccaaccccctccggcccccaatcgctcggctgccttgtgaagaaggtgtcctgcttccccttggccttctgccacgattgtaagtttcctgagacctccccagccacgctgaactgtgagtcaattaaacctctttcctttatcaattagtctcaggcagttcttcatagcagtgtgagaagaggctaatataaatggtcactcccctttgcccatcccccagcccctagcaaccactaatctagtttctgtctctgtggatttgcatgttctggatatttcatgtaaatggaaatatatgctacgtggccttctgcacctggcttccttcactcagcataatgctttccaggttcactgacgttgtagcatggatcagtttcttcattcccttgtttcttttaatattctgttgaggcagtatcttgctatgttgcccaagctggtcttgaactcgtgatctcaagcaatcctcccaccttggcctcccaaattgctgggattataggcatgagccactgtgccctttctttcctctttttgtaggggttaggggtcagggtcttgcactgtcattcagactgcagtgcagtggtgcaatctcggctcactgcaactgtctcctgagctcaagcaatcctcccacctcagcctcctgagtagctgggaccacaggcacacgccatcatgcccagctatttctttgtatttttttgtggagatgaggttatgccatgttgccaggctgctcttgaactcctcagttcaagtgatccccctgcctcggcctcccaaagtgctgggattacaggcgtgagccatagcggcggccctttcttccctttttctgactgaataccattccattgtatacatgggccaagattcacccatcaatggacatttaggttgtttccactgtttgtctactgtgagtagggctgctatgaacatgtgttatgtaccagtatttgtttgagttcctgttttgttttgagatagagtctcactctgtggcccaggctggagtccagtgatgcaatcatagttcactgcagcctccaattcctaggcgtaagcaaccctcccacctaagcctcccaagtagctgggaccacaggcatgcaccaccatgcccagctaattttttttttttttgtagagatgggtcttactatgttgcccaggctggtttcaaactcctggcctcagtgatcccctcaccttggcctcccaaagtgctgggattacaggcatgagccactgcacctggctgggttcctgttttcagttctttggggtgtatacgtgggagtggagttgctgggtcagatggcattttttttttcaagatggagacttgctctgtcacccaggctggagtgcagtggtgcaatctcggctcactgcaacctccacctcccgggttcaagcaattctcctgcctcagcctcccgagtagttgggattacaggcgcccaccaccaacctggctaatttttgtatttttagtagaggcagcatttcaccatgttggccaggctggtcttaaactcctgacctcaagtcatccacctgccttggcctcccaaagtactgggattgcaggcatgagccgccgtgcccggccatacatttctgctatttataagctgccgccagtctgtgatgtttgttatagcagcctggacggactaagactgcacctcacgggcacagcactcgccaggtgctcctcccagcctccccacttactcctcttacagcctcatcccaggaggatgctctgaggctcaacaggtttgaaccgaatgcaaacagctggcacattaactagctgcatcacctcggccagacccacttctcagagccgtgagttgctcctctcagctgggtgaacacggaaaccctctgcggccttcctgtgccactacgctaaggggccaggtggacgtcaggcctggctgctttctgctacttacgctgccctccagggcaggctggccgtccccgcccacctccactttcctacaaggctgggcttgccctggatgcccagctgtcttcactttgaggacaatcaggcggccccagcaatgggatttaccagcatcctgtgctcagggaggtggagacatgtactggaccatcagcgctgttactctgggatttcccttccggtgcacattctctacagaagaggggccagtgataggaaacacttcccacacccttaacctacaagatggctgtcagcacgtgcgaaggtaatatcgagttgaaaggaatgaagtactaatgcatgctactccatgggtgaacctcagcaacaatgctgagtgaaaagccagacacaaagggtgcacatattgtgtgattgtgcagacatgggggtggctgctaatgggtacagggtttctttttgggatggtagaaatgttctggaactagtaatagtgaggctaactgatgtataaccttgcagatggcactaaaagccactgaactgcacacgtttaaagggcaaatattacagtatttaagttacgtctcaactaaaagaatcacagagttgtatcagcgcagtatgtctcactcagtgtacattggctgaatgtttattgagcaaagatcatgcctgttctaggcacaaaaaacagaatccctgcctgcatgggagtgaccatcttgagaggatgacatagaagaatcagtgtaatgttccagcctgtgcccctgctgggggccagccccagaggccatagctggatggagaagattttacatgaagtcaggctcgtagctgtgattaatctaaaagatgagactatgtttgtggtggttgttgttttaagagatggggtttccctctgtcacccatactggcatgcaatggcacaatgatagctcacagtaacttcaaactcctgagctcaagcctgcctcaggctcccaagtagctaggactacaagcactcaccaccacacccagctaacttttttatttttatttttagtagagatggagtcttgctatgttgcccaggcttgtctcaaactcccgggctcaagcaatcctcccatctcagcctcccaaagtgctaggattacaggcatgagccaacatgcctggcagagactatgtttataagttagagtggataaacacttgtgatagcccaaatacatttccctaaagatgtccctgtcctaatttctggaacctgtgaatatgttcccttatatggcaaaagagactctgcaggtgtgatgaagttaaggatgtttgagataaggaagtcatcctgggttatctgggttgggccaatgtaactgccagaatccagaaaagcagagactatcagctgcagagaaccagagaggagggaatttgagaaggacgtaacccaccattgctggctttgaagatggaggaaaaggccacaagtcaaagaatgtgagctgcagcctggcctggaggtgcacacctgtagccccagctactcaggaggctgaggcgggaggattgcttgagcccaggagttgaaggttgcagtgagctgtgatcatgccactgccctccagcctagatgacagagtgagatgcagctattaaaaataagaaagaaagaaaaaaaaaggaatacaggcgccttctagaagctgggagctgggcgtggctggagtggggagggtgagagacgacagagggagcgccgtgtgttgaggactgggtcacagaagcctctgtgggccacaggaccatgtcagtttaagtgtaagtctgataacctactgaagggctcttttcatctattcaaaaaaaaatttgcaacaagataaaccttaaaacttgaaaaaggccgggcgcagtggctcatgcctataatcccagcacgttgggaggccaaggcgggtggatcaggaccagccaggccaacatggtgaaaccccatctctactaaaaatacaaaaattagctgggtgtggtggcaggtgcctgtagtcccagctactcaggagactgaggcaggagagttcctggaacctgggaggtggaggttgcagtgagccgagatcacaccactgcactccagcctgggcgacagagcaagactccgtctcaaaaaaataaataaataaataaaaataaaaataattgaaaaaaacagaatctgaaaaaaaaaaaaaaaacccagttataaaagatgaggggatagcttagagaagaaatcagccaatggctgtgactgcaaagttttttatggagatgtcagaaagggaggaggagctgtgcttgggcttgtctggtttgctttttcctacctgatcctctggcatggaagcgaatccaggtggatctgcagcaaacctgaacctgaggtttcccaacagaaggacatgaacgtggggttccttctcagctgtgtgggccctcacagccccccagcgagagaggccttatgcctcctgaatacctggctcacccgataagcaaggagctcctatccccaagcccttccagagtcacctccacacctaatagccaagtctgaatgctcagtcccacctgggaaggctgtctctgcagaaacagcagctactacatgcttcccgagaggagagcgggggacttgcctttcgcctccccattccctgcacagctggcattcttgcacagtctctagctttcatctttgtacttccatacaccccaccccgtttcccccaggagttgaggccgcagccttccagatgccgcaggaagactgaagatggaagctctgcagagctgactggtgccatccagtcttgggtttgcctctcctgtctgatgggacgaggtggggtagggggctggagctccatgggatgcatggctgtcactcaaaaccctaccagattcctggcaaatatcacaacccccaccccatcgggacttcaacttggaagatcagctgtgtagacaaagggatctgagtgagaaaggacacccttctacaatgagacaagaggaaagaaacaagcccaaagagcttcgggaggaaaagaaacacttccagcatgttttgcctcccacactgtgactggttcctggcatggctcttccctagcctggctgggctgggagcgggtgagggttgggggtatgtctcagcaatgtgggccaggaaccagaagctctgtatgagactcagataactaacggagaggctttctgcaaagggctgggtgtttgagagtgcagaatctctgcattccagaccctgacttcgggctgggcctctgaaacccacaccggggcagaagtctgaaccccaatccacagcagatcaggagaagcctgcgccccccactggctgaagacccttggtcccaacatcctgccttctgatcactgagctccaaatgaactcccaaatactatccttggggtaaggagggcttcatgattgcctgtcccagcttctcagggccctgtctgtcctctgggtccagacagttctcagattgccctgtgggaccccatcccttttcccccacatccccaccgtgggtggaggtgaagtaatatatcctctatggcagcagagggcattacttttctcccagcttccttccagcactctgagacgcttcttctacccataactggcatctataagacctacagttgtgtcagacctccgacctctccaacactgagggatgctcagagacatgccaatcatgagagctgcagggccatggctgtatcacactgctgattacctactcaaagccatatttcctttttccctcagtaacataacctggatgtcatgagggcagctgcatgctcggctcacagagtctatttcctacctcctttagcagctaagtgtggcatgaaactaagttctggccaggcatggtggctcaagcctgtaatcccaacactttgggatgccgaggcgggtggatcacctgaggtcaggagttcgagaccagcctgaccaacatggcgaaaccccatctctactaaaaatacaaaaattagctggtcatggtggcaggcacctgtaatcccagctacgtgggaaactgaggcaggagaatcgcttgaacccaggcggtgcaggttgcagtgagccaagatcgtgccattgcactctggcctgggcaaaaagagtgaaactctatctttttcaccctaagagtgaaactccatctcaaaaaaaagaaaagaaaaaagaaactaagagtgaaactccatctaaaaaaaaaaaaaaaaaactaacttctgaccgataatatgtaactggcattgtatgaaactcccaagacactacttaaagctggctcaggggaacacaggcctctattgcattgcattgctctcttcccacttcctgatgcccagaatgtaggtgtgatgactggagcaccagcagctatattgggccatgacactttgaggatggaagtcacacgataggatagtgacgcaggaaaatcaaaggaacctgggtccctgatgtccatcacaagtgtcctggattgcctacctctggacatctttagcatgaaagagaaatctctaccttgtttaagtcattattattatatatattttatgtagccaaaatgaatcttcactgatacacctaattggctggctctgaccttgactatcttccctggagaattttcacaaccaggcatatctcagtttggttcagatgtgtaagagtttgggagctaaggtaaaaagatggaaggaacaagcataaaaatgaagtaagcactaaacttcaggccagagagaccaaagttgatgatgtgatctacataaggaatgtcaatgattttagagcggggatctactgggattacccaatatattctatagcctacatatgatctctatttactgatattggctttaaaagtaaatttattcaataaatggtgctgggacaactggatatccacatgcaaaataatgaagatggacccattagtcacctgtgcacaaaaattctaagtggacctaaatttaagcattcaaaccataagaaaacataggtctaaatctttgtgaccttgggttaggcaatgatttcttagatatgacaacaaaagaataagaaatcaaggaaagaaatagaaaaattggacttcatcagaatgaaaaacttctgtgctttgaaagatatcatcaagtaggtgtaaagacaaaccacagaatgggagaaactatttgtgaatcacgtatgtaatatgctacttgtatctagaatatataaagaactcctacaactcaataataaaaaaccaaatagcccaatgaaataatgtgcaaaagaggtgaatagatatttctctaagaagatatatacatgaccaatcagcacatgaaaagatgcttagcatcattactcatcagtgaaatcaaaaccatgaggagctaccaattcacacatgctaggatggctaaaattaaaacagataataacaagtattgacaaggatgtggataaactgcaaccctcacattactgctagaatgtaaaatggtacactcaccttggaaagcagtttaacagtttcttacctggttatacctagagttaccacatggctcagcaattacacacctagatatatactcaggaatatgtgatgaaaacatatgtccacacaaacacttgcagacaaatgtcagttgcagcattattcctagtagccaaacaatggaagtagtcaaaacaatggaagcacacaaaatgtccatcaactgataaatggataaacaaaatgtagtatagccttacactggaatattatttagcaatgaaaaggggttgttttagtccatgtaggctgctataacaaaatatcacacactaggtggcttataaacaattattgctcacagctctggaggctgggagtccaagatcaaggtatagcagatgtgatgtctggtgaggccctgcttcctggttcatagatagcaccttcttgctgtgtccccacatggtagaaggggtgagggaactctctggggccccttttacaagggcactgatcccacttatgacctaataacttcccaaaggccctgcctcctaataccatcaccttaggggttagaatttcaatacaggaatttttggagggacagaaacattcagaccataacaggaatgaagcacagacatgtgacaacacggataaaccgtgaaaatgttacactgagttaaaaacccaaacacgaaaggtcacgtactgtatgattccattgctatgaaatgtccagaacatgcagctccacagagacagaaagtagataagtggttgctgggggctgtggggagggggcagtgaggagtgactaataaccaccacagagatgtagaggggatgattaaaatggtgtaacatcgataacggtgatggttatgcaattctgtgaatacacgaaaaaccactggattttaggctttaaacaggtgacctttataaagctgggttttttgttgttgttgttgtttgtttctattgttttttgagatagggtctcactctgtcgcccaggctggagtacagtgacacgatcatgtgctttgacctcctgggctgaagccatcctcccacctcagcctcccgagtagctgggaccaccgttgcaccccaccatgcctggctatcttttttttattttttgtagagatgggtctcactgtattgcccaggctggtctcaaaactcctgggctcaagcagtcctcctgcttcagcatcccaaagttctgggattacaggtgtaagccactgtgcctggcctacaaagctgtatttaaacaaaaaccagaacaaaaaacaggcaaggaggggctcccttcaaaggggacctgaatcaagtggaccatgaacttggtgggggcaaatgcttcctggatttggagccctgccatgccacatccagcttctctgtgtcagttcagctttctatgtggatgtttcctcaacacatgtgcagcccacctactgtaacagctgataggtatcaagagctggcaacgtttcaggactgttcttaaccatatacaggggttatcacatttactcttcacagtgaccttgtgtggtgggtaccatttcacagctgagaaaacagaagtccagagaagttaaacaactcgccaacagttacacagctcacgagtgactgggcatcagttcaaacacaccagtgccccagatactagccactgagtaactccctgccaagcagccacctccagccccggcattctcaggttccagatttagcatgaagtgtcaatatatacatcctttgaacctttaaatataataaaaaattgtttatgcagtggcttatgcctgtaatcccagcactttgggaggccgaggcaggaggatcacttgaagccaggagtttgagaccagcctgggctgcatagcaagaccccatctctacaaaaataataaaattagccaggtttggtggcacatgtctgtagtcccagctacagactgaggaggccgaggtggaagaatcgcttgagcctgggaggttgaggctgcagtgaaccatactctcaccactgcactccagcctgggtgtcaaagcgagaccctgcctctaaaaagtaaaaaataaacaataaaattgtttatgtacatgcccattctgttttagtatttgtccagttccaaatatttcatttattgaattacttgctttcaaggtttttaaaatcctcaagattttcttttattattttggagatggactctcactaagtttcacaggctggtctcaaactcctggcctcatgcaatcctcctacctcccaagtagctgggattacaggcacaagccactgtgcctggctaatattttaaatgtgcctttggcctcttataaaaatgagctgctgtggatgtttctaggcggaggggccagctgacagattctgaatgacggtgtctgcaacactgcaaaatacttttaaacgctcagtgccatctcttatcttccctctaaaatagaactagggcagaaatcccatttcctcggtgaatacctcagtcctgccgatctccggatcaccagataagcatccactgcatagcaaaacagccaccagaagcaggcactgtacaacagctggatccacatctgcaatcgggaagagcctgcatcaaaatgtctggaaacaggtacaagaagcccagcccatccttgagacggcagggtagacactggcttcctctgacgtcaggaagccgcacgtgacagctctcgggacacaagtgggcacagttcctgggaccaaggagggtgtggcctgggataggtgtaggcattcagatttgactaaggaactatgccttctgctccacttgtatgcagggaggatgaagttccaagatatgtcatttaaactgaggtgcaggctcaagggggctttgaactagatagaagctcttgttctgaggaagaatgagtacggggaggagggactcaggcagtccttccaaagagaagatggagtaaggggactccagtgttagaaacgacacaaggtcaagatgtctcgccactgcgggctgagacagagcctccatagatgcagttaggaagccactgaggacagggaagcaaggaaactggcaattctgctccagcacagggcaatcaacacagcatcagggaatgtgcttcaaatcactcacctgagcaccaccgtgacggatggagcataacatacatgtgtatgtgtgtctgtgtatatatgatatctatttactttttcaataatttgtttatatataattatgtggttttattttttttctttgaagatggagtttcactctgtcacccaggctggagtgcagtggcgcgatcttggctcactgcaacctccgcctcccgggttgaagcaattctcctgtcttagccacctgagtagctaggaccatgggcacacaccaccacgccgagctaatttttgtatttttagtagagacggggtttcaccctgttgaccagggtggtctggaactcctggcctcaagtgatccacctgccttggcctcccaaagtgctgggattacaggtgtgggctgccgtgcccggcttgtatgttttatttaatatatttatgtatatatttatacaaaatgcatccaatggattgataactttttctgtgccagctggttttgctcgtggccccatgtaagcggaggatgcatttgtgaagaggtgggagaaacaacacttgagtgtctgggcagcatcccctggagggttttgttaaaacagagagggctgggttcctgatcagcaggatggggcaggacgtgagaacctgcatttctaacagactcccagggtttgctgctgctgcgatttgaggagcataagtagggaggagagggcatgcagagggggtggactcaccgcactccccacgcagaaagcagcaggccaaatttccgtgtggttcatatccgagacgctgtcaacaaaatttgggaatcctaaccacacggtggaccggatcaccatacctaagagagaattggataatactttgtatctgatcctaatcaaatataaagctgacttcttgctttggaaaaatgatagatacataatagatagagataggaagagaggaaggaagaaggaaggaaggaaaggagggagggagagagggagggaaaaagacaaggagggaaaaggaagaaaggaagaaaaaacatacatatttgtgtgtgcagagagagaaaaagaagattgaaactcataaaataacttttttttatttttattttttatttatctttttttttgagacggagtctggctctgtcacccaggctgcagtacagtggtaaaaaccctgctcactgcaaattccgcctcccaggtttaagtaattctcctgcctcagcctcccgagtggctgggattacaggcacccacaaccacgcccagctaatttttgtatttttagtagagacggggtatcaccatgttggccaggctggtctcaaactcctgacctcaagtgatctgtccgccttggtctcccaaagtgggatgacaggcgtgagccaccgcgcctggcctgaaactcagaaaataacttatggtagcaaaacaaacgcaggcactttaacgcaaaccatagttggccacagtctcatccctattttgtttgtctgttggtttacttgcaatatgtgactagcaatctggatttctcggctgcattttcagtggccatattagttattcctcacataaaaaagaatttttcaaaaagcacaatttagaagtttgaatatatagttccttcattcttttttaaacacaacatttaaaattttcacaaattaattctcaataatttgcctttaacatttattctttgtgagtttctcttgctattagacccaaatgtctaatatcctcaaaacagtatgcacactcatggtacatattatggttctttgttaggtaatgcaatatccgttgtttaaaagtacactagggtctgagcgcggtgctcacgcctgtaatcccagcactttgggaggccaaggccggcggatcacttgagcccaggagatgacaccagcctggcaaaaccccatctctacaaaaatacaataattagctggaggtggtggcacgcgcctgtggtcccagctactcaggaggctgaggtgggagaatcgcttgagcccggaaggcggaggttgcagtgagtcgagatcgcaccactgtactccagcctgggcgacagagtgagaccctgtgtcaaaaagaaaagaaaagtaaagagcctggcatggtggctcacgcctgtaatcccagcactttgggaggctgaggtgggtggatcacctgaggtcaggagtttaagaccagcctagccaacatggggaaaccacatctctactaaaaatacaaaaattagccaggcacggtggtgggcacctataatcccagctgctcaggaggctgaggcacaagaatcgcttgaacctgggaggtggaggttgcagtgagccaagactgtaccactgcactccagcctgggcgacagagtgagactccatctgagaaaaaaaaaagtatgctaggtaatataaaggggagaactgtaaacaacaccaagctacatactatgtagtagtgctcactggtaaacatgccatacaccactaaacacacactgtgcaatacactactaaaatcacaccatataatatgcaacacacaccatgcgatacaccactaaacaaatgctacgtaatatactactaaacacataccatgtaatataccactaaacacacactatgtaatacactactaaacgacaactgtgaacactaaaaagctcaagacatcttctcattatcaagccactgccaacaaaaacaatgcctttcttctgtacggtgccttagaattttcagcatttatcactcctttgagcttaataaaagccctatcccatgggcattgaaatttcttatttttcagtaaggggtcccgatcacccagccttttcctgacttctgcttatttgctcgcaacctcatccacttcccttctaaaggctaaaggatatgcaagtattattcactaaccctcaaaagatgtttgggtacaccttacttttttagagacagggtcttggctgtcacccaggctggatcgtagctcactctagcctggaattcctgggctcaaatggtcctcctgcctcagcctggtgagtagctgggaccacatgtgcatcccaccatgacgggccttttttttgttgttttttttttcttgggggtagagcctgggtctcgttacgttgcccaggctagtcttgaactcctgggttcaagcaatccgtccaccacagcctcctgagtagttaggattacaggcgtgagccaccgcacctttaggaggccgaagtaggaggatcgcttgagcctagaagtttgaccagcctgggcaagatggtgagactccagctctgaaaaaataatgcaaaaattagccagtgtggtgatgcatgcctgtagttccagctgctcaggaggctgaggtaggaggatcccttgagcctagaagttcgaggctgcagtgagctatgatcatgccagcacactccaacctgggcaacagagtgagaccctgtctcaaaaataaagtgataatgatattggggttgcaaatgtttagaattattatgttttagggctctctctgagatctgaatgggcaggatgatggagcctgagattggcttcacattaatccagtgaggagggtgaagaggggagcagatgagccgggtacccgtacctcacgaatcccacgtacagggattcactgtaagtgtttctattatagactgcatttacgcatggtggaaatgttccaaaaagctaaacagaatggccaaatctagctgagaggtctgtataaagtgtcacataatagtttaaagcagatgttggcaaactcattcttaatatttttggctttgggagccatactttctcagtccaatattcaccctgcccttgtagggtaaaggcagccatgaataattcacaaatgcacatgaacaacatagctgcgttcccatcaaactttatttgtagacattaacatttaaatttcagtaatagtcacatgccaggaaatattttttaattttgatttttaaaaacattttagggctgggtgaggtggctcacgcctgtaatcctaacactttacgatgccaagggtggtgatcttttaattaagcccaggagttggagaccagcctgggcaacatagtgagaccccacatatatttaccctagcatggtggcgtgtggctgtagtcccagctactcgggtagctgaggtgggaggatcgcttgaacccaggaggtcgaggctgcagtgagctgtgattgtgacactgcactcaacctgggcaagagggtgagaccctgtctcaaaaaacaaaatcattaattttttaaaaagtaggatgtaaaaccattcttagctcgtggaccctagaaaacgggcaggatttggtctgagggctgcagtttgcgcacctgtggtgtaaaaaccatacccaaaaagcctggatagggaagggatttcagcttacaaaatactcgagagaatatatagtgcacaatagaaaagaatttacacacgcgcacacacacacacacacacacacacacacacacacacacagagcgagacagagagaagttaattgttagtctctccctggtgcagttgggcaaaaatgaggaaatcttttctggtctgggttttgcttaactgcgccatctgaagtttccatataacaaacacaataaacggattttttaaaacccaacgtcccttggatgggaattttaccgaccatgtgtttgcaaaactacctagtcggccgggcgcggtggcttacgcctgtaatcccagcactttgggaggccgaggcgggtggattacctgaggtcaggagttcgagagcagcctggccaacatggtgaaactccgtctctactaaaaatacaaaaattagtcgggcatggtggcgcgcgcctcccccagctactcgggaggctgaggcaagagaatcccttgaacccgggaggtggaggttgcagtgagccgagattgcgccactgcacttcagtctgggcgacagagcaagactccgtctcaaaaaaaaaaaaaaaaattacctagttgtcccatccggtccctagggaacagcctccgctttctcttttctctgtggttcaagtgttaagacggccagcccaacccgctagccgtgcgccatcacccgggcaccgatcaagttccaacccgagtggatcgagttccaacctgcgggccatgcgccctcacccgggcatcgatccggtctcaacctgcgggccacgcactctcacccggggattgagcaggtcccaaccccagggcctcacgccctcaccccagcactgagcaggtcccaacccgcgggcctcaagccctcagccggggaccgagcaggtcccaaccagccagctacgcgccctcagccctgcaccgggcaggttccaacccgcgggcctctcgtcctcactccatcacggaacaggtccaaatccacaggccgtgcgcccttatccgggcaccagtcgggtctcaacctgcgggccacgcgccctcacccaggcgctgatcagattccaacccgcgggccgcgcgcgcccttacccaggcagccgagaaggtcgcaggcagcggcagcgcgcaggatgcggaccgaggccggcggggacgtcgcgggggacccggggcccgcgggccggcggccgggcagcagctgcagaaggcccagcgccaagcggagcccgccgctgcccaggcagagcgcgtggaaggcccgcggctggaagctcagcacgagctgcgtggctgcgtcccgcgtggggcagcagaaggtccctaggcgcggggaggccatgggctgtgttcgcggacgcggctcgggtgtgccaggaccccgccggcctgcctgggtcatgtgctgggcgggctgggggcggcatcatgtgccctgggcctctcccccaccccaacccccagcgcctgcagtagagccaggctcggtgggggccgagagcactgggctaacgccacgaggcctcacgaggtgatgcttgggcgggcggaggaggaggacagagagagggagggctgagaggagaggaagagggaggaggaggagggaagtggaaggagaagcagaaaggttgggaaggttacctttctccccattcaccaagccttcctggtggtttctctgccacctagagcgccaaacctgccatctttactggtcttctagagaaacaggcctcgtggactagatctttcctatttgggactctgacatcctgattttgatgcctttaaggcgccagaacatgttcataaactgtgactgatccctgtaactgcttttttcctaagtagagatggttgtccaattagtgcttttttttatggcctctctcattcatggatataatcccacagaggcaggattttcgtttacaattaatgaatgaaacaaacagatcaatgttaaagaaagagcagtagctcacacctgtaatcccagcaccttgggaggccgaggcaggcagatcgcttgagctcaagagttggagaccagcgtgggcaacatggcgaaaccccacctctattaaaaatacaaacattagcccggtgtggtggcccaggcctgtgatccaagctactcggcaggctgaggtgggaggatcgcttgagcccaggaggtggagtttgcagtgagccaagatagtgccactgcactccagcctgagcgatagagccagaccttgtatcaaaaaacgaaacaaaacaaaaattagctggatgtggtggggcgtgcttgtagccctagcttctggggaggctgaggtgggaggatcacttgagcccggcaagtggaggttgcagtgagcagagattacaccactgcactccagcctgagcaatggagtgagaccctatctctctctctcacacacacacacacacacacacacacacacacacacacacacagaattaagtttaaaatttaaaaacattaaaaaaataaagggaaaagtactcagcataagtacacacagacacattttgcaccttaactttcagttctatttatttggatttttcttaactgcgttaatttttctatgttttctcatacattgaaaatcttgctttattctatacatgtaagtttccaagtaatattgtgttaatgattacagtaagcatactaagatttttttttttaagttcttcaaggctgaaaatagaagtgctccttctagattatggcctttattttaaaaaaagaaaagaaaaaaaaatccagctccatcatatttatcatcttcaacaaacctcattggctctttgtgaccacacaagagacacccttcctcctctctcctggtaaaatgggcccctctctgggtttttttcaagcaaccaaggtgcaggtgtccccattgtgttcatggactttcctcacttgttctccccaccagctttgcggttttaaggaaggcatgatctgtgccgtcttcctctagggatagcaggactggccttcccttgggaccccacagaaggcaggcgggaggctccactgccagacaggaagcggagccttatttaacaacaatgaggtgcaaactccaccacttcaaaagagtccagatctggcacgtctataaacgcagcctgttcactccacagctgccttcctagaagtcagaacagactgacatcttcagaaagcttaacagctctgctggattacacactccattgtaaaaacagtcagaagcaccatagaactactccccaagcattaatgtttaaaagcttgaattctaatatctaatttggacagtggctctctttccttctgccttggtaagcagagttgcttctggaggttagtgtaatggaaagtgctttaaaagataaaaatgaagagtgtctgtacatttgcctgaaggttgagggccagtgggccaggcaaaggggtccctgcatttgagtcactgtttcatgccccagaaaacacactccgcctctctgcttcctacgtgataacctgggagtactctccagggggctctggctgactctggtgcccactactcaagctcagtagtcagaatctcatcagtgagaaaatggatatgaatgcagattcctagggccatggcacagatgacaatggtaaagatgagcctcagagtaaaggtgcagaagcatgagtgtaagactaaatttaaaaccctgtcatcaaagtgagagggaactagaaattggtatgagaggctgggcccagtggctcacacctgtaatctcagcacttaaggaggctgaggcaggaggattacttgagcccaagagtttgagaccatcctgggcaacatagtgagagcccatctctagcgtcttcctctaggagcagcatcttttgaagtggtggagtttgcagctcattgttgttaaataaggctctgcttcctgtctggcagtggagcctcctgcctgccttctgtggggtcccaagggaaggccagtcctgctgtccctagaggaagacgacacatctcaaattagcagagcgtgctgctgcgcacctgtagttgcagctactggggaggatgaggtgggaggatcacttgagcccaggagtttgaggttgcagtgagctgtgattgcaccaccaaactccagcttgggtgaactgagatgacaaactttttttttttttttcctttgagacagagtcttgctccattgcccaggctggagtgcagtggcgtgatctcagctcactgcaatctctgcctcctgggttcaagtgattctcatgcctcagcctcctgagcagctgggaccacaggcacatgccatcacactcagctaattttttgtctttttagtagagataggtttcgtcatgttggccaggctggtcttgaactcctggcctcaagtgatccacccgctttggcctctcaaagtgctgggattacaggcatgagccatcatgcctggcctgacaaaacttttcatgaaacagtacaactacaaatctgagaaaagtgaagcaaatacacacgcacacacttgggaggcagaaacatctggaagtttcgtagatatgggagatacagggatggcggtgctgaatatgaactttgaggtatgtgtgcagaaacaatcggtctttgagtacatgaaggtacatctgtttttgcatgaacccttcctccgtttttccctccttcccagtttagcacctgaattcgctctccattttcacagtttgggctgcctggggcatctgttccctggaaatgctccatcatcttggctttctctcattccacaatccaccatttacccaccattcccacttgatcagatgcacttgatcaactgctggaagacggttcctgagtttctctcccaggcagtttatttttcatggtgagtcccctgacatcgagatgtctcaaccaaaagaatggggtttatggtgagactcagatatcccttagaatccagtagaggaggtggctaggggcagatggatggcagaaacagcctaagtaaggagactgccattcacaataatttgaatttaaataataaataagatttgtttatttatttattgacatggagtctcactatatcatccaggctggagtgcagtggtgcgatctcagctcactgcaacctctgcctcccgggttcaagtgattctcctgcctcaggctcccaagtagctgggattacaggcgcctgccaccacacctggctattttttgtatttagagtacagacggcgttttgccaagttgtccaggctggtctcgaactcctgacctcaggtgatccgcccgcctcagcctcccaaagtgcggggattgcaggcgtgagtcactgcgcccagcctaataaataagatttaaataataaaataatttatggagtgtaggcaggcactatgctttgaatattacattcattatctcatttaatattcagaatgagccttccaagtgggttttactgatacttaaattgatatagacaaaacatggccaggtgcagtggcttatgtctgtaatcccagtactttgggaggccaaggtgggagcattgtttgagcccaggagttcaagaccagcctggggcaacatagggagaccctgtcccccacctcccccagtcaaaaaaaaaaaaaaaaaaaaaaaaaaaaaagccgggctcagtggctcacacctgtaatcctagcactttgggaggctgaggcgggcagatcacctgaggtcaggagttcactacactccagcctgggcgacagagcaagaacaggagaaagaaagaaagaaaaagagagagagagagagagagagagagagagagaggaagaccagccaatacataagtccatgggtatggctgtgtgccaataaaactttatttacaaaacaggcaaagggccataggctgcagttcctgtaagtctaccacctgaggctctggcttatctagcagctgcttgaaaggctgggcaacaaccgagaaatggaggaggattaacacttagtggggcagacaaacttattccaatgagagaggaagcaggaagtcactggcagatgtattgctcacccttccttcctagggaggtttctgaggagtggtttcatatgttcctgtgtaaccagctgggtttcttgggaatcttgtggccagttcatgaatggcactgctcttaatttgctttcttccttccttgcctcaccctgcttttgtgctcactcctagagtccttatagacacacaatgtgccttaaactctgtgctcagatagctgctcttcctgagaaaggatttcagctgctccagccacagccctcttttgggtccaccagatgaccaacagcatctttgcctttcatttaagtgcaattcaacaggagtttatgagtaacatacgcaagttgattgagcaatggtatagattctgtgtccaataaataaggtagtgtcaccagaccttaatgaagaacacaggccaggtgcggtggctcatgcctgtgatcccagcactttgggaggccaaggtgggcagattgcctgaggtcaggagttcaggaccagcttggccaacatgaagaaaccccttctctactgaaaatacaaaaactagccaggcatggtggtgcagtcctcccgcctcagcctcctgagtagctgggaccacaggcatacaccatcatgtctggctaattaaaaaaaaaatgttgtagaaatgaggtcttgctatgttgcccaggctggtctcgaattcctggtctcaagccatcctttcaccttggcctcccagagtgccgaaattacaggcctgagtcacctcacccagaccaaattgtacatttttttaaatagggagacatgtgaagtggcatcaggcctgagaatggtactagttcaactttactgtgcattcgcgtgcagatcttgtggaaaggcaaatcctgattcagggtttctgggggtggggcccaagactctgcatttcttacattctccaaggagacatggctgctgctgacctatggctcctactttgagtgccaagaccctagagcttgtatcttatcctgaaaagcaaagaaaactcccaggccatatttgaatttatggaggacttggttcaaaatagatgcagtaaaattgattagcatccaactaagccatggagcattctctctcttttttttttttttttggatggagtcttgctctgttgcccaggctgtggcaatagagtggtgtgatcttggctcactgcaacctccgcctcccaggttgaagcgattctcctgcctcagctcttgagtagctgggattacagatgcgtgccaccacccctggctaactttggtatttttagtagaggtagggtttcaccatgttagccaggctggtcttgaactcctgatctcaggtgatccacccaccttggcctcccaaagtgctgggattacaggcatgagccaccgcgcccggctggagcattctcaacacagtggatgagtcaaggagggaatcattagtcggagaatggtgagcaatgtccttcctcttggattctgatgtgtttgggactaacctgggacagaagtcaggacgcagggaggaaaagaaagggaagaggaagacaacagataaggactgagagaggcaaatacgcgatttgtgttgaaaaataggatgtcctgacaattttctcctattgaaacttaagggagcatttccatcctggtctgttaaaataggaagccagtattgtgataaactcccaggagaagctcttgcccaagtgagtagcacattgccctcccatggacctatccatggctaacctcctaactcatcacactccattttaaatgctttctccgtaaaagtcaactagtcagttgttaactgtgagaacaaggtgaaaatggaaagtaaaacagggtttgcttcacagtgattcaattttcaattcacaattaaatttggcagaacacgtctatttcaaaaagaacaactgacctgggcgcagtggcttatgcctttgggaggctgaggtgggaggattgcttgagctcaggagtccaagaccagccttggacaacatatagtgagacctcatctctactaaaattcaaaaaaattagccaggtgtggtggcatgcacctgtggtcccagctgctgttgggggctgaggcgggaggattgcttgagcctccagggttgaggctgcagtgagccgtgatagtgtcactgcactccagcctgggtaacagagcaagatcctgtctcaaaaaaaaaaaaaaaaaaaaaaagacattgataacagtctgatggagtaaatatgccaaaagtaacaattttcatatagctcagagttgaaactggcatttgtgatggaataaacagcaagtagaaagaaaaggaaacaagacagatatgaaaagctgattgtggtatgagtggttgatgctattaaatgtttaatgactaccacaacagagccacaaataaatggacgagtacagactattaaagacagttcaatgtttatttaaattaacatcaagtacggtgttttacatgtaaattcacatcgcgtgctttttctgatgtgcaagaaagcatgcataattctacacgccttcatggtgagaatcgttctcacatttgcctgcctaaagacatctgtctgcctaaagacatttgtctacatttctttataagaatgtcagagtttcagttcagttcaccttatcctatttggtgatatttggacttttcagctcaaaaggagaaaaagtttttaaggaaaatttccaacatccacaaaaggaatgtaatgattttgagacctgatgcttagctatgtacttgagttcagttgacaaacgctcaaggcccattaaaagcaaacacttttacataaatctgctctctttggagtggctttgaaagtacacacacacacacacacacacacacacacataaacacacacgcacacacatatactttttcgtcatatctacaaacaaaattgactcttcattgaattttagaaaaattgccctggagtggtgcttcacacctataatctcagcactttgggaggccgaggcgggtgggtcacttgagctccggagttcaagaccagcctgggcaacatggcaaaaccctgtctctaccaaaaatacagaagcatggtggtgcacgcctgtggtcccaactacctgggaggctaaggtgggaggatctctgtagccagggaagttgaagctgcagtgagccgaggtcgcaccacttcactccagcctggggcgacagactgagacccagtctcataataataataaagaattttagaaaaattacatacacttcattgacagccaaattgaacttagaaaaaaagttttatttgtgcttttaagatcatgaatgatgaaaatgatttgttcaatcaaaagtcagcaaacccagccagatgcaatggttcacacctctaatctcagtgacttgggaggctgaggtgggatgatcacttgaggccaggagttcaagaccagcctgggcaacatggcgagaccccttcccacacctcccatcctcatctcttaaagaaaaaaaagtcagtaaaaccattccaatttgaaatgatgtcccgaatgtatagatgttcttgaatatcctatctcctaccaaagtcaaaagacagaaatcccattaggatgccagcttctgtgtttcctggcaggattcagtcccttgtgggctgtctccaaggccgtgtagttccttgtcacatgggcctccccacagggcagctcacaacaaggccggttggttcctcacagtcagcgagaaagagtccaccacagccactctcagggccgcctggtggggcgagggggctgcagtgttcctgtcccacttctgccagtcagccagtccagcctgcccctgggggtgggcacttcaacacccagggttggctggcccttcagcctccctgagtgagttcctgccacctgagcacgtcttcctacaaagaggggcaaggaccagcaactgagactgaaggaaatctttaatggacggaaggaggactccatcctggggtctctaggtagcatctgctgccctctccatccagaattaaatgtgcttggtttgaccttgtggaatggccaaaaatgcttagggttgattacaaaactttgagaaagtaaaacttgttgcagtggcttagtgtttggacttgaaccccttcttctcctcccaggggaatttggcagctctgcaaatattccacataaggattttttttaattgtttttttgtttgtttggttttttttgagacaaggtctcgctctgttgcccaagctggagtgcagtggtgtgatcagggctcactgcagccttgacctcccgggctcaagcgatactcccaccttagcctcctgagtagcagagacgacaggcatgtgccaccatgcccagctaactttaaaaaaatgtaaagacagggtcttactatgttgcacaggctagtctggaactcctggcctcaagcaatcctcccactttggcctcccaaagtgctgggattataggtgtgaaaggaatgggttttgaacacagacttagaacccagacagcctgatctgtggtggttgttcggtattgacctggctgaatgaaacatgagagtcttggactgtgtccatcctctggaaaacatgagaaattcatgaatggagaaatggtgcctaagggtagaacttcagctgtgcaacaggcagataacgattctgtgagccaggtggtctcagcatgggaagagaggtgaacaacaggagccacggagagaggtgggttgtgtactgagaagaggaaagttcagtgatattatatgattgccttccatgggctgggaacatcagatatgcatcgtctttcgtaactctcacctccacccctgtggctcctctgttttatcccttcttaatgcatgaggcaccagcagaggggaaggaactcgtctaagatcacacatctggtggagctgagaatcaaacccaggcagatgatgccatgagtactgccacaagagggggactggggatgccccttgcagtcaccaagagtgtctgcaaactagtccgacaagaaaatgcatcttctcaccccaccctcttgaagctgcacttttcttgaagtccacttttcagaaggctgaggcagttgcaggtggccgaatttgatgctaagtgcaactgtggtttcaaggaagtgtgtgtgcggcagggtgggctggggtgatgaggacagacatgcctatacacatattacatatttagcacattatactaacacattaaaatgagatgactctgggatgactgtctgccttggagtccgccttcatacaagactgtgaaatctcatgtatctaacaaaaaggactcaattcctccttaaccatagactttggctaattttgcaatgactgcttcccaggcactcaagtagccttgggtagagaataggaaacccacattaacctcaggggcatggctgcggttaaagctgacctgcaggcagacagcacggcttccctcaacactgcactgcgccctgcggagacattgtctgtgatgctcactagaacgcacgtcaggatcaggagcatgcaaaggcactaacatacccagtgtggtcagttactcctcagagcagagcctgatggtttaagtgcagtggccctttacccctaagtcctcggggtgattgctttgtcctggtttgaacatctagtgacctagagtaaacgtaacgtgtgtataacctgaggttcttaaatttgtgacatttcttcttttcaaagacagagtctcgctctgttgcccaggctggagtgcagtggcaccaccacagctcactgcagctcctgggttcaaggcatcctcctgccccagcctccccagtagctgcaactacaggcacatgaaaccatgcctagctttttttttttttttttttggtagagatggggactggccatgttgccaaggctggtcttgaactcctggcctcgagtgatcctcctgccttggcctaccaaaatgctgggattacaggtgtgagtcactgtgcctggcccaaacttgtgacattacttaattttattttatttttgagacagggtctcactctattacccaggctggagtgcagtggagtagttatggctcactgcagcctccaactctcaggctcaagcgatcctcccacttcagcctccccagtggctgggactacaggtacaccaccatgcctggctaatttttttctattttttgtagagatggggtttcaccatgttgcccagactggacatttctttattacaggagtcagaaaactttaaaaaatgagccagatggtaaattcttcaaactttgcagcccacctggtctttgttgcaattacccaactctgccataagaaccatgaagtgtccacagacaggaggtaaaggaatgggcatggtgttgtgtcaataaaactttatttggaggaacagatggacataatttaccaaccaccactgtattgtagcaaactaagtaaaacataacaataaaataagaaatatgcatgggcttttgaaatgtgtatttgttggatttttaagagtatttgattcggctttacaaaataaaagaaactcagccaggcgtggtggcacacacctgtagtcccagctacttaggagagtgaggtggtaggatggcttcagcctgggagattgagcctacagtgagctatgattgcaccactgcactccagcctgggtgacatggtgtgatcctgctgttagcctgctgggcagccatggtgtgaactgaatctctcagggagagaatgtgacacatttcaaaatcccgtacgtatcgtattttattgttattttgttttacttagttttctacaacagagcagggattggtaaattatgtccatctgtttctctaaataaagttttattgacacaatgccatgtctattccttttagagaccctgtctcaaaaaaacaaaaaaaagaaaaagaaaaagaaagaagtcacttcaaattaattatcatcatctctgcctcatcattgtacctgaagcatctgggatgtgtaccacctaaaattatgtacatggcctttttgtaatccattccagtctgagtaacatagtgagactccatctctttaaaaaaaaaaaaaagggggccaggtgcggtgactcacgcttgtaatcccagcactttgggaggccgaggcgggaggatcatgaggtcaggagatcgagaccatcctggctaacatggtgaaaccccgtctctactaaaaatacaaaaaaattagctgggtgtggtggtgggcacctgtagtcccagctactcgggaggctgaggcaggagaatggcatgaacctgggaggcggagctcacagtgagctgagatcgcgccactgcactccagcctgggcgacagagtgagactccatctcaaaaaaaaaaggaaaaaaggagacagcatgtaatgaagcaagcggcttacaagaaatgttggatgcatacattaagcagagagtatgtgagccatagatagatagggagggatggaagaaccaacaaggccccaaatattcctgaggtcttacactggttagcactgggatgcccattctggccactcgtgtcctctccctgagagacccaactcacaccatggctgcccagcaggctaacggcaagccacagctatggccaagaacactcgctcccacgtctttctgacagagctgcagtgctgacaccaagcaccttccatttgctgatcccctcgctcatgctcagttggggtcctcctaactgcatggccagaagggtgggatgaggtggcaggaaggagaaaaaagagagagataggtgtacattggcactgagtaactccagattaaggtagtgtggccctttccccagctgatatctgaccttaaatgtatccatcttgagcctgggagactgagactgcagtgagctgtgattgtgccactttcctgaccgggcaacagagtgagacctgtctcaacaacaacaacaaaaaaaaaaaagaaaagaaaagaaaaagaaaaaagagaaatttctcttgttctaagccataatggtaatttgtacacacagccctaggaaactcatacagtatcccaaaggcatgtcaaactccacctgctgaagcacaaatcattgcctcccctccttggctcttccacttcttccacttccaatcttccatttatctgtctctcaactcagttacttagcccagaaacccaggagttagttttaacacaccccccacaacatcacccccccaccccacacttcatttcgaggtctttgagccctcgaagcccacgcccccagcctccactgttttctgctcatgctagccaagcctccaggtgcgccccgcctccaccggaaacccgcaatcaccaggaattcccatcctcagcctcctctctcagtggccccttctgaaggaggcacggagggacacctggccctccctggcactgtgcctcctccagccatggagcatgggctgctttcctccccacacccctcctgactaccctgctcaggcagggggtggtgaaggcggcttcctggccccactcacctttttccacctgctttctccccacttaaatcccctgccttgaggctgctggtgtcctgggctcataccaccctgttctctgtgcaggtgaagtcatttgctgactccagagtcactccctttcattccctggctcactatcacccttttctttttctttgcttttatttttatttttgagatggagtctccctctgtcgcccaggctggagtgcagtggtgcgatctcggctcactgcagcctccacctcccgggttccagcgattctcctgcctcagcctccagagtagctgggattacaggcgcccaccacgacaccaaactaatttttgtatttttagtagagacggggtttcaccatgttggccaggctagtctcgaactcctgacctcaggtgatccgcctgcctcagcctcccaaagtgctgggattacaggcatgaaccaccgcgcctggcctactgtcacccttttccaccattctccagtgataaatcatgacagttccaatgttcctatcgatgagcctcacagttctgcagcttcttggttcctccactggagatcttgttctccttgcactcagccaccatgctgaggtcacaccgtggtctttgttacctaccggtggtagctgagtccctccaccctctccaagccctctccaagccctctccaggacactcagctccatgtgggaatgggtcgtgctgggtgacggcagacttgttgaaagaatgagctctgtggtcaccaagagaaggcactattggagggtcgctttgtgcatggagacagcctttttgaaactgattttgacattattctcctgagaagttgtgtaagaactggactcactaagagatttctgccttcctgtctttaagcagatcaactttccatgaaggagcttcctatcagcctgcagcctgcgttggggggtgggggcgccaccagaagaaccctcacccccacttcctctcagccaccaggatgcagctttgtctttaagacttggatgagctttgaaatatttcaggataaaaagtgggtgaaggatgaaacaagagttctacttttgtgtccattcgaaatttccacaatgacagatgaaaactaaaatattttacttatggctttatttatttatttactttggagacagggtctccctctgtcgcccaggctggagtgcagtggtgcaatcttgactcactgcagccttgacctctggggctccagcgatcctcccactttagcctcccaaagtgctgagattacagatgcaggccaccacacccggcccttatggctttattatcgtttttaacattctaatttctctcctgttgaaacttttgtagttaaaagtggtttagcagttaatcgtactgatttttcatgagatttccttttcctcactgctacagataatgtttcatatttcctgcaccattacattcccccccccccccacccaacaagtattgggcaagtaaaaagtgctcaagaaatgtatgcttactggcaattttattaaaatacaaaaaataggctaggtgcaatggctcatgcctggaatcccagcacttggggaggctgaagcaggaggatcacttgaggccaggagttcaagaccagcctgggcaacatagcaagacctcatctctacaaataataaaaaaattgggccgggcgcagtggctcatgcctgtaatcccagcactttgggaggccgaggcaggcggatcacgaggtcaagtgatcgagaccatcctggctaacgtggtgaaaccccgtctctactaaaaatacaaaaaattagccgggcgtggtggtgggcacctgtagtcccagctacttgggaggctgaggcaggagaatggcgtgaacctgggaggcggagcttgcagtgagcccagatcacgccactgcactccagcttgggcgacagagcaagactctgtctcaaaaaaaaaaaaaaaaaaaaaattagttgggcatggtggtacaggtcagtggtctcagctattcaagaggctgaagtgggggaatcgcttgagtccaggcagttgaggctgcagtgagctgtgattacaccactgcactccagcatgggcaacaaagtgagaccctgtctccaaaatacaaaacaaaacaaaacaaagcaaaacatagtcaatggctttctaaagcaatttttttatgtttctttgctctgtttatgggtcttgctctgttgcccaggatgaagtacagcagcataatcccgattcactgcagcctccgcctcccaggctcaagcgatcctcccacctcagcctcctgagtagctggtactacaggcatacaccaccatgtcggactaattttaaaatttttctttagagaaggggtctccttatgttgccaggctggtcctgaactcctgggctcaagcaatcctcccacctgggcctcccaaagtgctggggttacaggggtaagccaccgcacctggtcatcccaatgtttataataatagctcatagaaatcaagaagatgccaaaccttggtgacaaagggtaaacgttccgtgtcatagttttcctttttttggggggtgggggagataatatctcacccaggctggaatgcagtgacatgatcttcattccctgcagcaatccttccacttcagcgccccaagtagctgggatcacaggtacatgcttccacgcccagctaatttttttgaattttagtggagacaaggctctgctatgttggccaggctggtcgagctcctgggctcaagcgatcctcccacctgggcctcccaaagtgctggggttagcagtatgagtcagtgtgcccttcccacagatttccttcaactgcatcactcgtgctctctgatcttgactgatcctgtgccagtctgaattaataggaacacagcgggtttagtaggaagtggctaatattgccatttttaaaatgccacactaaaaggttttctggaaggcttgaccctacggagccactatttgaaatgtgaaagtaaaattttggaactccatcttctaccacattttgtaatgagtataaatctcttttctttttagaacaaaaagctaaaataatttgagctgtatttcataaagaagattagctattaatgaagtctctgaacgttggttaatttgccttacattaattaattcattcactgttgacgaagtgaaagcagaaccatcctcagtttcatctatctcttctctcataggaaataaacctcagattagcaaaagtggccggggactgggtgcggtggctcacgcctgatcccagcactttgggaggccgaggcgggtggatcacctgaagtcaagagtttgagaccagcctgaccaacatggtgaaatcccatctctactaaaaatacaaaaattagctggacaaggtggcgcatgcctgtaatcccagctacttgggaggctgaggcaggagaatcacttgaacctgggaggcagagattgcagtgagccaagatctcaccattgcacttcagcctgggcgacaagagcaaaactccgtctccaaaaaaaaaaaagaaaaaaagaaaaagaaacagtggccaggtacaatggctcatgcctgtaatcccagcactttgggaggctgaggtgggtggatcacttgagcccaggagtttgagaccagcctggacaacttagtgagatcctgtttctacaaaaaataaaaaattaggcaggcatggtggcatatgcctatagtcccagctacttaggaggctgaggtgggaggatcacctaagcctggggcagtcaagcttcagtgagccataatcgtgccactgcactccagcctgggtgacacagtgagactctgtctcaaaaaaaaaagagaaaaaaaaagaaaagaaaagaaaagaaaaagaaaaagtgaaacaaacacctaaggctactgaatccccggggcaggcgctcatagggtcacactccttgcaggtccagaagagagtatatgctcaccctattctctgagcaatgaacaaccacagtgagaaattacacagaacaaacatgcccctcagctttccaaaaggacaaaagactaacatggacaaatggattctgcttctgaaaattccacctgagttgtgagttctcagaaaagaaagccatctactaggagtccatacactggttcaacgtcatactaaaactctcccaatgggggtgcaagactgatcaactggggtgatgcctttcagccacaagatatattttcacaagattattgacagtgtcttgtgatgacaaaacaaacacaatatagaagtgctgtcatcgcacctagaccatagtaaccccaagaatatcacaaaaggatttatgactgagcaggcacctgtctcatagcaggccacacaaatcttggttcagtcccttacagcataacatcattatagacagcagccttataaatattccaaccatcctgagatggatgcttaatgtgaagattaaaaaaacaaaacaccccagctaaacactgtttagtaaggatggatgtaaatttctagctaagtttaagaacaagggagtccttttaaaaagtataaacctttcaagtggcagatgggtaatctgacaatgattacgtacggtgaacataaaatgttaaagatgactttggggctatatagaataatgctggatttatggagacaatgaaatcactgtctctgctttataatgagtctagtggtctgaattttagccccaggtaagagcttagactgaagtctataccagcttggggtggggaggtagggagtgggctgttttgggagacggacatgtctgcaaactctaataagcacactgggtatatttatacagctctttatcttttggtttatcatatccatccatttcttaaactttgtgagataactggatttacatgtagttgtaatgtgtccagagttggttccttccggtgggttcttggtcttgctgacttcaagaatgaagctgcagacctttgctgtgagtgttacagctcttaaaggtggcacagactcaaagagtgcgcagcagcaagatttactgtgaagagcgaaagaacaaagcttccacagcatggaaggggactggaccgggttgccactgctagctgcagtggccagcttttattcccttatttgaccccacccacatcccgctgattggtccatttacagagtgctaattggtccattttacaaacctctagctagccacagagcgctgattggtgcattttacaatcctcttgtaagacagaaaaattctcggagtccccacccaactggcttcgcctcttggtaaggaataatacagggaagtcctgtgcacccttcactcttcacctgcctgttccaatggcaacacgttacaaaactacagcacaatgtcacaacctggaatatggacattgatacaatccaccaagccttttcagatttcccgtttcacgtgcatttagttctgtgcaatttagcttaatcaacttggcagctcctgtgaccatcaccacagtgaagatacactcgacttgattctgagaggcacattccttaagccttcgtttaatctttgaaaaagaaaaaatcgcctcattcttctaactaaaggcattcagagactgtagttagaagttaattatggggcagtcaccacgtgcccagcgccatgacaggtgcccagtggagctgcgactctgaatttaatcggctgcatgagacacctccacagaatgcacccctctcacttgacctctgaagaaacagaccagagctgagatttcttgtcccagcttgacagtggcagaacccagacccggggacccttgactctctgtccagtgctctcccggcctgtcctggatgcgtactccagcatcgtcacctctgaaaagggcctggatggagctgcttagagaaaagaggtgttcaccagccttcagctacgtatagaaacagcaacgaaaacagcttttttgcaaagcatgtaaatacctatccatgcaggtactttagaccagagtttcatggaaactgaaaccgagcaggaagaggtggcacacatgttgtccgcaaactttcaccaatcccagacctccacctccccttttcggggatgtaaacctgggaaacttgaagaccttgtggtccaatcctaggcgagtggggacagcatctagacgcaacggctttctgcgcggtggctgtgggaggcctctgcgggaaggtgggaaggccctcgtggaaacggggcacggtccttctgcgcccgccttccaagcccctccagaggccggacccgcgcccggctcaggctgctggggggcgcccttcccggctctctaagtccagagtgtgagtgcgcgcagggccgcgcgggacgggcggtccctctgccccggggcagcggccacagcgcgggcaccagggcctcccgcggcgcttccgctctcacctgcgcggcagcccgcggtgcgcgagaacaaagtgtgggcgccggcgggccgcgcgccccgagacggaggaggccggagactcccgccacgccaccccgcgcccatctcacctgccgcctcacctgcccggtcctggcctccaaccggcgggcgggggcgcccagagcttcgaagcactgcagagctctggcgcgggaggaaaggcccgacctggcgccggggcctccgcccccgtcctcgcccgcgctggctccgccagccccggggcgcgcgctcctcgaccccgaccccgaacccgctgaacggcgcgcgcgcctgagcgcccctcccggcccgctcccctccaccgggcgagagaaccggggcgcgcccctctccagctctccccggtacgagcggccgcgtgggcccctgagcgcgcacctgaccccgtccctcacccttcgggccgcgggctggacctctggacgcgctccccgtgaccggccccgcggtacgagctcccgaacgcgcccgccccgccccccgtcggccccgccccctccccgccagccccggccccggccccggccccggccccgccccctccccgccagccctccgggctccctccgccgccgggccggcactttctttccaagttacggcgcaagttctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttagagaaacctgaaagcctgcttcctaagagcaggacccgagttctaataataataaagaaattccagatgtatctcatcaggaatgttgtgtgtgtgtgtgtggtttgctttagaacattgaattttattgtctcaaaacaaaatccatctggaaacttaccagttgaacctgtatgaacttgtaaaagcaaacacataaacaacagtccagtcaccctgtgttctagttaaaagtgtgtagtggtcattttctctgggaagggttgagtcggacctttcgtgtggacgaagttccttttaaaatgtaaagattcttggcgactagaagcgtttgaagataatttactggttttctcggctttcctgcctctccacagcaggaagaaattaagtgattcctaacccgccgcactggtaatcagtttgggaagtgggatggctttgttgttcaaatagcaaatgagacaccagcgtcttccattctatattttctgtcgcttttatgattacaaaactttgtggagggatttggagaagccttgtttagctttgcactaaatttttgttgaactcaggaaagaggttgccattgttataaatttgaccaatgtgtaatcttttatcacactggcttctttggaaacatggtggacagtcataaagtgtgtatactctgcccagccagaacactcctcttttttttttcttttatttcttttcttttctttctttctttcttcttttttttttttgagacagggtcttgttctgtcagcctcctgagtagctgggaccacagatgtgcgccaccatgcctggttaattttttaaaattttttgtagaaacggggagtttcaccattttgcccaggctggtctcgaactcctctgcctcccaaagtcctggcattacaggcatgagccactgcgcttggctcagaatgtggattaatccaagctttgaatcttcctctcccaaaagctactgaaaagtcactggggctcattaaaaaatagctcttctaatcgtttttttttttccacttgtaattaaatagttacatattagagccctggaatactgtacaactcacttgctatttagcagactctgatttggggatagcttgcattaaggtaagagcgcaccttctctttatgataatgagggtatcatttgaaagcctcatgggagtgcgtgtagtagaactgggaggggtgtcaagaacaaggctggttcggtcctggtcttcagatggaattttatcagcccattttatagatgaaacagctgtggcccaggcagggcaaatggtgtatcctgaggtcacaaactgttgagtcctgggaaaggccctaagaatcagactctggccccagtgttcaagcctgctgctccccttcagtcagtgccatctgcttgggtctgggatctcctgcaatgccatattgaataccttcgtcacatcggttaggtgagggtttgccagccttggcattggggactttgtgagctgaatctctttgctgtggggctgccctgtgctttggaggatgctcagcagcctccccagcctctacctgcttgatgctactgtcacctctctccaggtgtgatgacaaaaatgtctccagacattgccaaatgtcctctgggggcaaaattagcctggttttgaatctcttttgttagattaaccatatatcacctttgctcttaaaggattcttgctcttaaaacttctgtttctttttgaatagactggcctttagggtggtgtgtttagaggcctctggcattgccagtgtttgcatggagagctgttttcctcccacgcgttggccctgagaataggctttatttacatagtcaaactcaaacaaatacttgcttcatctgcattttttgtagctggagaaaggaaattgaagcaggaactcccaagtgctgtgttttatgggcatccacagtggctgttcagaatcaggactgactactctctgggtctagtttgaagctaaagggataccaacttcagaggagtagcattcttggaatttggggtgcatgcatgaagcccagcagaacctccgctgacagatggcgacaggattcatcactcctcagtacgtttctgctgatttctgccttgaaattttgctacagttggtggaaaaaatgcactcaaacccatatttccatgctgttgttagagagggggcaggaataacatccatgctgtaggaatctatgtaacggaagtagagatggtggatatatgtgatcctggtgggttttttgcatgtttctgttcccatccattcaaccagtggaagtcttcagtggggggaggggaggggactgatttctaaaatgtcactagagtggcttgaattccacaaagctgtttgggggattcatgaggaagcgttaaatacaccagctgggtgtcagcagccccctgtggcctcaggaatgtttgttaagggagggaaggaatgaagccccagcctctcctgttcactatttcttagagtccgctccctcccccaaaaagaatgccagaagccttagcccgaagctccaaagaagacagtaacttgggcctggcctagccccaagggcagctcctttgggaacccattgattttcgggttgccattgggcaccagagctgttgtgtgcgacaagactgctgtggtctgggacgcttggaggtcccccccacctgactcacccaccccagggcttcagactctgagaacatttctctggattggagacagagctttgaaatgtcctttccagtgtgaatgccaaagacggaatcagggcatattttggggggcgtgcagccaggtggcaagtgtcttatgtaaagtgttagctgagtccttgattgcagagggcacagggctgagactggtggttggtgatgggcaggagtggaggccccgcgcctctgatgtaccttacttattggtttggaaagggggctctgcattatgggccatgccaagtcacctcgtgacccgaggaccggggagatcagagtgaccaccctggtcgggatcagttcttgtctcatatgccattatattggctcccaagagccaaccaagctctttgtgaaatatcagtaaaggttttgaaaaagagggacctgatgaattcagcagtgggtcaggagcgggtgactctcaactttgtggctgctggtggatttttgtgcccagatgcagtgtgcggtcaacatctgcacgagggagtgctgctgcttctccaggtgtctgagaaccagtgggtgagggcttggatctcccttgcctctgccatctctaagtgatgtccgagttgtaaagctttactcactttttgatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaagtctatctttattaccttttcccagcctgtgaattaatgtgaccctgctgaattctcatccttgttctccggcgatgttttgggcaagagtgtggagtcaggcagtgagcctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttgaaaaaaaaaaagaaaagaaaactagtttgcccaagagctaaaggtagaatagtatgataatgaaaggctcagaacaagtagcagttttcaccttgtcctaatgagctgggggtttcttaatctacctttgtaattcatggtcaaaaaaactggcttgccacttgggaagggctggtttttctctttggaaagcattttggagttgtttgtccccttgccagagttgttttgtatcagcatgcaaataaacctggatttgtggccaagttcttaagggcagtggagaaaagctggggctctgtggaacttttcttcttgcacaccgggtgcagcggaaacattctacacgataatgttagaatgtaaaagctgaatggactttttattcaggtcttcttttactttcaagcactgtagtcagcagtggggcaattcatgaaggataaattctgcaggtttctgcaagccctcttcctacacatgcaagccgaaaactttaacccacatgaaggattttgaaagagttctgggttgcctgttgctcttttaggcctttaaaaaaatatcaccagtgccaggcacggtggctcacgcctgtaatcccagcactttgggaggccgaggcgagtgaatcacctgaggtcgggagttcaggaccagcctgaccaacatggagaaaccctgtctctactaaaaatacaaaaaaattagccgggtgtggtggtgcatgcctgtaattccagctactcgggaggctcccgggaggcagaggttgtggtgagctggagatcgtgccattgccctgggcaacaggagcaaaactccatctcgagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaatagaataatcaccagtatctgatacagggagggtgtattctggaggaattgttgtcctttaccttgtgtgatgcagtatttgggctgtcctgtagtagagccagcctgttcccattatgggtgtgaatgttccagcttctctttgggggaacatgtcttagaaggataatactatatcattaaaaagaaaaaattggacaaacctcatttggttgaaccttagaactaggatgttctgaattgcaaagcaaaggtaacatttttttccccagataaggagcccctgggctgtttttttgtgttgtttttttttttgttgttgttgttgttttaaatccccagcgtattaagttgcaggcaatgagggctgcttcttttggatggaaagggaagaaaaacagcatcttggcttggctaggaagggctgggattatctttcttttggcaaaaggtgactttcagatcaaaggcaaattgttgaggtcaacaagaacccaggcagggtagactctgtgtccttgaaaggtaacacttcttactcatagaagggaaggggcaagcatgatagcgtatttttttttttttaagacagattcttgctctgtctcccacactggagtgcagtggcatgatcttggctcactgcaacctccgcctctggggttcaagcaatcctcccacctcagcctggcgttacaggcgcacaccaccacgccctgctaatttttgtatttttagtagagacagggtttcaccatggtagccaggctggtctctaactcctgacctcaagtgaaccacccgccttggcctcccaaagtgctgggattataggcatgagccatcgtgacacgctaggagtgtcagtgtatcttttatgaggttttattttatcaaagtggctcttgcacagtatgaattatcaagtagttcttcaagggtgcttatatgctactggtcatttggcctgactactgatcacttccccctccctagagacaactatcaaaacgtcttagctgatttcttttggtatttctgtccatatccctaaatgatggcttatattgtatattgctgcaacttttgtttattagcttgttcttcccaatgtaggatattaggatgtagccttttttccactctttttttttttttgaaagtctcgtcctgccactcaggccagagtgcaatggcatgatctcggctcactgcaacctccacctctggggttcaagcgatcctcccacctcaccctcccgagtagctgggattacaggctcgagccaccatgcccagctaatttttatatttttagtagagatggggtttcgccatgatggccaggctggtctcaaactcttggcctcaagtgatctgtccacctcagcctcccaaagtgctgagattacaggcatgagccactgcgcctggcccttatttccactctttttcattgctcatctaccctcccccaactactcaggcacaattcttggcccttcatacccctaatgtgattacatcataattttttggtgtggggccatcctgtgaattgtaggatcttgagcagcatacctagcctcttcctttctttttttttttttagacagggtcttgctctcttgctcaagctggagtgcagtgtcatgatcacagctcactgcagcctccatctcctggactcaagtgatccttccccctcagcctcctgagtagctgtgactacaggtgcatgccactatgcccagctaatttttgtattttttgtagagatggggtttcaccgtattgcttgggttgatcctgaactcatggcctcaagtgatcctcccaccttggcctcccaaaatgttgagattacaggcgtgagcaactaaggctggcctcttccccgctctgaggagcatggggttaccaatattcagtgtttattttggttgctattgctatcactgctgagtctgggggtacatactgtggagtcctgataagttagcatcaatgaagaagggaccccagggtgggggagaacaattgttctgagaaactgctaaccacaaacaactctgcgtgtagcttctccagcatgatcctataaaacttccctccagcccctgcctctttgcaaccccttctctgctgtgttgcctgttgctcccttgcaacatactttttctctaataaattagtcttctcttctcttctcttctcttcttttcttttttctgagatgtagtttcgctcttgttgcccaggctggagtgcaatggcgagatctcggctcactgcaacctccgcctcccaggctcaagtgattcttctgcctcagcctcctgagtagctgggattacaggcgcctgccactacgcctggttaattttgtatttttagtagagatggggtttctccatgttggtcaggctggtctcaaaatcccaaccttgggtgatccgcccacctcagcctcccaaagtgctggggattacagacatgagccaccgcgcccagccataaactagtttttctttaactgactactgtctcagtaaattcttttactgcccgtgactctggccccagccagtgtacccacaacacaagtttctgcagtcactagggttcaggatagttttctttgcttaattttcagtgcacttatccttgattcatccctcaaaccctccccagtgatgaaatatctcttaatatattcagacacaccgggggtcatcttttgagatcttctctgtctgaaaacagcatgatttttatcttgacagtaaattgtttgggcgtagtcctgaatggagacagttctcccacagcactctgaaggtggtgtccactctgctgttgtgcagtattgctggagggagatcagacgtttttgtttcttgatcttttgtactaggtctactttttccctctcatttttctttttctttctttctttctttcttttttttttgaagagacagggtcttgctgtgttgctctggctggagagccgtggctattcacaggcacggttatagccacactacagccttgaactcctgtgcttaactgatcctcccatctcagcctcccaagtagttgggtttacaggtgtgtaccactatgcccagctctcttattttgcatttctttgtatttttgttcttcctggaagattttgttcaacatcatcttctaatctttccattaagttttaaatgtatgtcctcatttttccctcagattctaaacttttaaaatttgtttctcaaatgttcctttttcataccatactgatcttgtttcatgattcttccatatctgtgacagtattaaactggtctctaaaaatgtcctctttttgcatagattgtttctgagctctgcttttgttgtttgttttggctgctttcttccctgttagaggttgtcttcaaatgtctagtgctccttggccgtctgctggtattgaaggttgcgttccccaaaatgctgtttggacactccgtgcatgggggtgagtgatcaggtgaagctgtttccctgggtattcctctaaggctgtatctttctctttttttttttctggaggggcagggaggcggccatgtttttgtcagatactttttttctacttaataaacttctggtgtagtacaggttgaaaagtaatgggaagtctgccagttgaggggatctctcctttgctcagctgggcgagggtgatcatctctgccccccaactttggctgtagtggttccagtttggagggaaggttaccactaggcagaggaggcagtgcttgcttgcttgcatccggagctggatcttgctctcagttcctaaccgtttctaatcagtaatcctctgtctgtccaactagaatcattcctattttattgtggtatcatggggattaaatgaggcaacacataaagctatctctagtaaattcaaattccccctcacttctcttcctcactttccctactcaatcctgattcattaagaatttggaactttgggaggccgaggtgggaggattgcttgagcccaggaagtcaagacaagcatgggcaacaaaatgagaccccatctctacaacaaatagaaaaattagccaggcaaggtggtatgtacctccagtcccagctacttgggaggctgaggtgggaggatcgctttgagccaaggaggttgagggtgcagtgagccaagatcacaccactgcactccagcctgggcgacagagtgagactctgtctcaaaaacaaaaaataaataaaaaataaaaataaaataaaaaatacatctaatgcccagcatcagtacatttcctatgttatttgtagcccaccagaagtgattctttcctctcctctaccaaaaaacttttttccagaataatagtgtttcttatttttataatattaataaagggagtagctctttcagatcaatgtggtattcagagtagggtttttatttgtttttttgtttgttttgatatggggtctcgttctgtcattcaggctggagtgcggtggtgtgatcacggttcactgcaacctcagtcacctgggctcaagcagtcttcccacctcagccccccaagtattaggactacaggcacatgccacctcatctggctaattttttgtattttctgtagaggtagggtttcgccatattgcccagggtggtctcgaactcttgggctcaagtgatctacccaccatggctaccgaaagtgctgagattactgatgtgagccactgttcctgggccagagtagggtgttaaaaaagtagttttgggaagtggcaatagtgggaaagatgaagattcagtatccctgtgacaagactctatttcttcactctttcaatctttggagtagaaaatctgttagggtttagagtgggacccacaagtgtggcagaaatgctgcctgcccgagtccttgttgcctcctcctctcagacactgttgggccacatttcccagcctccctagcagttagctgtggcctcctgacgcttctaccctggggagtgcagctgcagccatgcctgccattttacttttccccttctggctgcctggaatgaagatggccgcagggcagagttcatcagcgtggatccctgaatgactgcagaggtggctgcccatgctatggtcaccatccatggtgagcaagaagtaagcctctgctgtgtttgggccattcattgtatgttttttggattacttgctgtaacagactattctcacaaatgaaatgctgggagaaatcagaagttttccttctagcaaatatacccagctttaagaggcggaatatacggtgcttcttttacacccatgctggaaggagtgaggaaagcatcactgtgggtgtccaattagcatgaagcctattccctgcacacttattatataaaatgagacctccacgcccattggcgtctttccacctccttacccttttctctcagctggtaatttattcacccccaccccccacttgctcttccttctcctccccggggatgatttcctgggagccctggagcattggggcaggaggccgggagaatgcccagtctagataattagtcctaggtggggctggccggaggcacagtgggtggggtgggtggccagctgctgttaggatgatttcagggattggaccttcctcctggtggtggtgtcctttctttaactgccttggttaaaatgcaaatgttgcctgggagggctacacattgtcatcattaacagaactgccttcatcagattaattaattatagttctgtatggcagacttttttccccctggtagtagcacccagacacatgaattagaccagcaaagagaggagagataaagttgaaagccagatgaaagccaagtaaaactggcctcgggaggaaggtggagctggcggagtgggagtgctgaggaaagaccttgtctgttcaggtactggccgcctacaaagaggagttaggacagcctgtggaggaagctggtagggagagcaggggcccaagtccagctgaaaaccctccctggacttgcaaaagaggtgaaagagattctttacctatggcttgcagattctgaagctgacgaaattccacatctattggtgttaattgtgcatctgtttgcaaatttgtaaacatggtgatatttatctctgctaattgtataatgctttgtacagtgtcttttttcttgttgcacaattaaaatgaaaaaaattgaaaataaaggaaaagattgatccatagcccaaaacatgtaataatcttatttctgaaagtacagctgtattgatttttccccatctctgtggaattctttgctttgaacctcgtagatctaatttttaattgcttgaaaacccttaagaattacattgtcaacaatctttggaatcagatgaaaggagtttaattgtgtgtatgccacttgacgttttaagaaatggtatgttttgttgtggaatatatttttataatttaggtttttctagacaggcatatttttaaaaaccctaatttctggaaaacggagtgtactttatattggtcaaatatgtcagtctttcaaacaactatgcttttttgtatgtgcagcttttcttaacattttcattatgtttagatgccctgaatcttgaattaaagtttggaaagaaaacatctggacttgaaaagataggcctgctgctgcttcaatcatatttattttgtgttgatttaacgacagagctctcacatgctgatgccattagggtttgggacggagccatttccactccccctcctcatttttagtggctggtgttttggggacaagtaattaaaacttgtaccactattcatggttgtgaaatctcaacacaaaggtaaaattcctgaggatgcacctccttgtaccctgaggcaggaacttgtttgcctttacggagagtttaattcttttttttttttttttttttttttttttgagatggagtctggctctgtcactcaggctggagtgctgtggcatgatcttggctcactgcaacctttgcctccccggttcaagcaattttcgtgtcttaacctcctgagtagctgggattacaggtgcgccaccgcgcccggctaatttttgtatttttagtggagatggggtttcgccatgttggccaggctggtctcgaactcctgacctcaggtgatctgcctgcctcagcctcccaaagtgctgggattacaggtgtgagccaccacgcctggcctgagagtttaatttttaattcttaaattacccattaattaattaccattaattaagaatttttaatttttaaattacccatgttgtaattgcttcactgaaaaaaatgttcaattcctatgaaaactctttatttccccttctttctatttttacagtggcttacactggttcttttcctttgccatctactagaaggttggatttcttgaaggtccttttatctgtcctctctctctcatctaggtggtctcatgtgcttcctcgagataacgtgcatctgtttgcaaatttgtaaacatggtgatatatggtgcctatagacaatgctcatatctatatgtgcagcctcaacttctcttctttttttaattttcaatgaccattttaccaaatcaacttttcgtctgaactctgagatggcccttgtgtgttgctgaggccctttaaactcagcacaatccaaatgggaatcattcatcttcctttaccttctctaattctgaatttctaatcttgatcatcagtttatccccaaatctagaagtcgtccctgatgccttcctccccttaacctcccacagccagttgatcaccaatcctttggagcctaaatacggggtgtgcattgctttcttctcatgcccagcgtcactgcctccagtggtttgctccagtgactgcctgggcaatcacagtagtctgtaacatgcatactgctgctcacctcttcacatgacagactcttgagacctccagtagtcggtgtgccaaaacagtggtctacttctcatgctcttgctggaaaagcctcagtaattcctcatgggacaccttagctaggtatagaaggcttatttattttatgtattattattattattattattatttgagatggagtcatgctctgtcacccaggctggggtgcagtggcgtgatcttggctcactgcaacctccgcttcccaggttcaagtgattctcttgcctcagcctcccaagtagctgggattacaggcacctggcaccatgcctggcaaatttttgtatttttagtagagatggggtttcaccatgttggccaggctggtcttgaactcctgacctcaagtgatccacccgcctcagcctcccaaagtgctgagattacaggcatgagccaccatgtctgtccactttatttttattttatagagatggggttctcatctctgtcacccactggagtgggtggtatgcagtggtgtaatgataaatcactgtaacctcaatctcctgagcgcaagtgattctacccccaacccttgcctcagcctccgagatagctgggactacaggcatgcggcaccatgctcagttaattatttttattttttgtagatacagagtctcactgtgttgcccaggctggtcttgaactctggcctcaagcaatcctcccaccttagaaggctttttatgttttatcgatcctgcctattttccaccctcgtttgccagtaactcttcatgtaacactgtattagtctgttctcacgctgccagacatacccgagactgggtaatttataaaggaaagaggtttaatggactcacagttccatgtggctggggaggcctcaccatcatggcagaagaacaaggaagagcagaaggatgtcttacatggcagcaggcaagagagaatgagagccatgtgaaaaggaaaactccttataaaaccatcagatctcatgagacttattcactaccatgagaacagtatgggggaaactgcccccatgattcaattatctcccaccaggtccctcccataacatatgggaattatgggagctataattgaagatgagatttgggtggggacacaaccaaactgtatccaacactttagctgagtatgaaaagttcttcatgctttagcatctgtcttttccctggcctcatcttctgctgttacccaccttgatccttcagtcctgcattgtctaatatggtggccatttgtcatatgtgactgttgaacagttgaaatgtagctggttcaaattgagatatactgtaaattaaaatatacactggattttagacttagtctgaaacacaaaagatgtaaaatattttaataataatttattatgttggaattataatattttgactacattgggttaagtaactcaaatatattattaaaattaacctggccaggcatggtggctcgtgcatgtaatcctagcacttgggaggccaaggtgggccaatcgcttgagcccaggaattcgagaccaggctgggcaacatggtgaaaccccgtctctacaaaaaaatacaaaaaattagccaggcgttggtgactggcacctgtagtccaagctgcttgagaggctgaggtgggaggatcacctgagcccaggaggttgaggctgcggtgagctgtgattgtgccactacacgccagcctgggtgacagagtaagaaacaccctgtctcaaaaaataaaaattaaaaataaaaataaaattaatttgacatattcctttttactctttgaaatgtagctcctaaccaatttgaaggtagatgtgtggtgctcttagtctgttggacagctccgttttagcctttttttttttctttttttaaaagagatggggtcttaagctatgttgcccaggctggacttgagctcccgggctcaagtgatcttcccacctcggcctcctgatgccattggcactacagtcgtgcctcaccatgcccagctcgctgcagactcttgttaggcaaagtgtggtttttaggtcagcatatccgcatcacctgggagctcgttagaactgcagaatctcagcccctgccccatacctgctgaatcagaacccatattttaacaacgtgattcagtcacatggtaaaaagtttgctgagtgctgctttagagaatgatttgctggtctcccagcatcctctgttatttgaggctttgcagaggttctgagacattcacagttttgtggaaggctttgctcagaatacatcacccaggcgaagtggccctaactgtccatccccagtcatgtggaatgccctcggtggccctctgtaatcattggtcttgcagcatcctcaagcctacttgacccgggaggtccctgagagtggggactggctctgtttcattgctggtatcgcgggcatattgcctggcatgtaatagatcctcaaatattaaagtcctttaaacacagcttacacgtagccttgagatgggatgaacgactgcacattgttacactgttctgagcaccgttaggtcctttgtccccttcctttttatgaggaccatctaagacaaggtaacttgggctgagagtgatctgtctggatcatgcaggtcgtacatggagtcaggatccctgaagtctccatctgggtgacatcacagctgcagatttctttttttttttttttttaaatgaaacagcatcttgctgtgtcacccaggctggagtgcagtggcgtgatcacagttccctgcagccttgacctcctgggctcaagcaatcctcctgccttagccccctgagtagctgggaccacaggcacacaccaccccaacttctgacttggttttttgtttttttttttttgtggagatgggggtcttactatgttgcccaggttggtcttgaactcctgagctcaagcagtcctcctgcctcagcctcccaaagtgctgggattacagttgggagccaccacccctggtagcatcccagctctttctccctctttacctccttgctaaacaagacactcaagcctatcttactgtgtaagccacatgagccatacaaagacttcttaaaaataattttttaaaaatttgtaggctgaaaagattttagatttttttttctaaaacagaaatgcacacagcagccttgctttgcggtaacccttggttccatgggtatgggactggctcaggtgccagaggctgggtggagaggcaggcctccatgctgtctctttggtgcctgcccccaggactccagagaagggtgcccggcgcttttcccacccgatggtgctccgtgcctcctgtcaggaagaaagcagaactgactgccacacactaccagattcaggagcctctcctgtcttcctgggaaggtggttttgatgaggtactgatgaacttgggcctggtttttacaaaatgaacatagccatcagttgtgacattgcacacagccaactcttaggaggggccgccatcacagaccacctccggacacagaagtcaggattttagggttttctcctgtgcatgcagtatactccatgggcatacaagggaaaagcagtgctggtgagaatctgccagcactgttgggcagcacgggttctcgacaggtattgttttatgtgcgtgtggtggatataaggaccaccaaccagtctcgataacaaatctagccgtttaaacatccacagacattttaacggtcctaatctgtggtcactcacagtgtctggccttgggaagatggactgggtgggttaaggaaggcccactgggttaactagatcgtgcccgggttgggaggatggcacgttaaattctgtggtgtctgatgtctctttctgttagctccccgtcttcctttgacaactccccagtggatgaggtctttggagaggtggaggctgaaggagcatggctcatggtgcagcaggaggtggtgtgtgacttaacactccttcccaggactctgagtctcaagcagggcaaggctgggtgcagtcagctctgtggcctgctgtggctgatgggccggggcccagagacaacagcttggatgcaacggtctacaagcccagcctccccaggctccttgtctctggctcatttctgaccctttacctaagactttcaacaatccttacattcctggtagcatcttagtgaatcaccctttcgcttagatataggaattcatttccgttgcttgcaaccaagaaaaccatagcctgaaacagcctagtaggaagcctgcagacctgagatcagtgggaccttaccactttgttatttgtggccctctggaaacgtgccatctgacccactgcaaggaagagtctctgcttcagaaggtcagaggagcggcatcctgagactggctgtggtgagctggtgggtgcagctgtctcctgcacactgacctgggtggctgtccccagacctctgaaaattgggaggaaccagggtttccttttactttaccctcaccagcactgcccagtctggagccctggagggtggaacgttgtaggaatgactcctgggctctgtagaacccctactgtatgccagcagctttgcattatgccgtgagttcctgggctctgggaactgctgttgtcccgtgtcaccaagtcacatggcattggagtggtgcagtcagaatccacatagcagccaggcacagtggctcatatctgtaatcccagcactttgggaggctgaggtgggtggatcatttgaggtcaggagttcgagacgagcttgcttggccaacatggtgagaccctcatgtctactaaaaaaaaaaaaaatacaaaagttagccaggagtggtggtgtgtgcctgtaatctcactccggaggctgaggtagaagaattgcttgaacctgggagacggaggttgcagtgagccgagatcgcaccactgctctccagcctgggcgacagagcgagactgtctcaaaaaataaaaaataaaaaaataaaagaatccaagtagcatctgccaaatctccactgtgctccaggcactgttcaactttatgtgaacttcacagtggttctgtggggtaggtttatacagttgttattggtgctatgatctgaatatttctgtccccccaaaattccggtgttgaaatcctaacccacaaggtgatggtattaggaggtgggggccgggtgtggtggctcacgcctgtaatcccactttgtggggctgaggtgggcagatcacttgaggtcaggagtttgagaccagcctggccaacatggtgaaaccctgtctctactaaagattaaaaaattagccgggcatggttggcaagtgcctgtaatcccagctgctcgggaggctgaggcagaatgtagggctgatactggagttgggtcttctatagcggagggaagtcagggatggaggccaagatgggctgattttcctgctgctgctaaaaggaaaccaattaatgggagaagacttgagttgggacttaaggagagtatctgttgtggttctcacgagttggagtggcatcgcttgaacctgggaggcggaggttgcagtgagctgagatcacgccgttgcactccagcctgggtgacagagtgaaactgtgtctcaaaaaaaaaaaaaaaacaaaaacaagaggtggggtctttgggaggtgattaggaatggggtcagtgcccttataaaagagactcaggtagttcttcctcccttccatcctgtgaggacacagtgagaaggcgcctcctacaaaccaggaagtaggtccacagcagacactgaatccgccatgtcttgaccttggactcccagcctccagagctatgagcaatacatttctgctgtttttgagcctcctagcctgtggtgttttgttacagcatcttgaactaagacagttagtgaggagcgttaggcttagagaggttgagaaacctgcccgtggttatggcagggccagtctcttcactcgcacagcaggcacatcgctggggcccatgaacatgttctagttttcacaagaagaaaatgaacttttaggtccccaaaaatgtttcgagataacatttcaatatttaatgatttactatataatattaatatatataaaataatcaaatacatcaagttaaacagattaattgaaatacattaatgatctagattgtgtgtatatatatatgtatgtatatatatgtgtatatatatgtgtgtgtatatatatatatatctgtctccttgtgccagcacaatcatcacatgcaactttaatcctttttttttttttttgagacagagtctcactctgtcgcccaggctggagtgcagtggcactatccgggctcactgcaacctccagtgtatatatatgtgtgtgtatatatatatatctgtctccttgtgccagcacaatcatcacatgcaactttaatccttttttttttttttgagacagagtctcactctgtcgcccaggctggagtgcagtggcactatccgggctcactgcaacctccacctcccgggttcaagcaattctcatgcttcagcctcccaagtagctgggattacaagcctgcgccaccatacctggctaatttttgtatttttagtcgagctgggctttcaccatgttagccaggctgttctccaactcctgggctcaaggtatcctcctgcattggcctcccaaagtgctgggattacaggcgtgagccaccacgcctggcccaactttaatccttttttatggagatggggtctagggaaggcctgccgggccctgggtcgcagctggcaagtgaaggggttgggttcccacccattctgtctggattcaggagcctcatgaaggtccctgcctcgagtatgtctgagcctggatgatcccccagcagggtcacagccagccccgtcgccatgcctagcgcataacagatgctcagtagatgtttggtaggtgcaggaaagccagcctgtgaaagggcgctcatccttcctgcattcaagcatcaagcctggtcattctgctgctttgtttcaggcgtgcgagtttgggggcaaatgtcagagtgtccccaggagcaagcaggttgcacagggggctgtttccatgagcctgggctgaggggacctgttgggaggccggcagccctgggagacaggaacaggcttcaggtgtttctaaggatcaaggccttggcgtattgcaaagacattacaaaatcaggcttccagaggcctcatagcaacaggcgtgtcacatagcctgtgctgtgccacggaaataaaacccgagttcaggactgcatgctgcctgctggtctaggccgtaaaaaaagctgtccatgccccaacaaaaaagtaaagcagagaaattagactcctgagattaatttgcttttctttcctgttttccacattgcttgtagcaaggtgatgcttttctgtgaaaaggcatttctcactgtctaaagggagcccttctgtgatcctccctgagagcagcccttctgagtgtcctttcctgcccgccctaggctgccaggctcctgctgctaacttgactgcttctgaagtctctttttaaggttcaatgtcaaggggaggtcagagaggggcgtggttcagcaggaaaagaggaagagagcctgacttgtgaccatcctgggtgccaggcacacctgagcacatgcagccccgagcttttggcctggacaagcccaggcctggcaccgcagggagaactggtctgtggattgtctccacagcctgatttcctcccagactttgccccgcttggagcattccgatctccggtgtttgagggtttcatccagtaaatacggtagtacttcaccctctcagattaaaggtgtgctgtgcagcctgggagttcctttacttgggggtggtcggggaggctgaaggaagccttcctgcacttcttttttcttgagttttttaattattaaaaatggagactgtgcgctgtggctcacacctgtaatcccagtgctttgggaggatcactggagcccaggagttcgagaccagactgggcaatatagtgagactctgtctctacaaaaaaaaaaaaaaaaattagccaggtgtggtggtgcacacctatagtcccacctacttgggagcctgaggctggaggatttggcttgagtcagagagttggaggctgcagtgagctatcattacggcactgtactccagcctaggtgacagagtgagaccctgtctcaaaaaatttttttaaaataagtggatataatggttgggcgcagtggttcacgcctgtaatcccagcactttgggaggccaaggtgggtggatcacctgaggtcaggagttcgagaccagcctggccaacgtggtgaaaccctgtctccactaaaaatacaaaaattagccaggcgtggtatcaggcgcctataatcccagctactcgggaggctgaggcaagagaatcgcttgaacctgggaagcggaggttgcagtgagccaagttcgcgccattgcactccagcctgggggacaagagtgaacttcgtctcaaaaaaaaaataataaaaataaatggatgtaattcacatgtcacaaaattcgccatgttaaagggtacagtttagtggtattttttctgtatattcactgacttgtgcaatcatcactttaattccagaacatttttatcaccccaaaaaagaatccctacatccattagtactccctcccctttccctcccttcccccaaatcccacccccacactgatctgctttctcttattagtcagggttctctagagagacagaactaataggaaatatatatgaagaggagtttattaagtattaactcacatgatcacaatgtcccacagtaggccatctgcaagctgaggagcaaggagagccagtccgagtcccaaaactgaagaacctggagtctgatgtttgaggccaggaagcatccagcacgggagaaagatgtaggctagaccagtctctccttttcacgcctttttgtctgctttagattagatggtgcccaccagattgagggcagatctgccttccccagcccactgactcaaatgttaatctcttttggcaacaccctcacagacacacccaggatcaatacttggtattcttcaatccaatcaagttgacactcagtattaaccatcacaagtccaccccttgtcaatgtgagatcgtacataatcttcaagtaaagacaatggtaaggtcataattacgcctaacatgcaactatcctttgtataaccagaaatgcatcattccccaacccaaatactattacataaagctgataatacttaaatgctgatatgaagtcaataaatctttttttgagacagagtctcgctctgttgcccaggctggagtgcagtggcacgatctcagctcactgcaacctctgcctcctgggttcaagcgattctcctgcctcagcctcccgagtagctgggactacaggcgtgcaccacgatgccagccaatttttttgtgtgtgtgtttttagtagagacggggtttcaccatgttttccaggctggtctcgaactcctgacctcaagtgatccacctgccttggcctcccaaagtgctgggattacaggcgtgagtcactgcgcccagcctgaagtcaataaatcttatgtcacacgataagggaaaagaaaagaaaataaagatattttcctagcactagtacaagtgtatacatgcgcaaacatggttttagcaaaaggaggaggaaatactcatgacaattgcagtccccatgtctgcagctggtcacatggttgtagctggtactgatgactaccctcttctactacccattctgtattccctttgccttcagcaagcaccttagctggttgtgtgtttttttttgcctggtggagtgacccaaaccttcattcctgaagggtctgggtcatttgtagtccggcctggattgggctgttgtagtgtccccttgaccttaatcacagggcatggtaatactaagagacgccctaatgggtctcctgtattgcatgcatactcttccctagttccattgcggagtagtagactgattttatctgatagtctgggtcagtcaccccagccaacactgtaactcccttcttagcctgttgacttaaaggtaggaggagcccaaagcacccaggtggcaatctgaacttccagtttaatggaatcattgttgtgtctcctggtggcagcgttcctccctctggaactaagaccccctaggccagcagaacgtaatgttgcaggaacaggaagcaaaaattttgctagtggatcactaggggtgatggtgagttttgccacttctacttgcaccccttgatttctggactcgtgaatcctggctatgggagaaacagtaccatatattgggcgctgattcagagcatacatggccttctgaagaactttgccccagccctgcaaagtattgtcacctaattggtgttataattgtgacttcaaaaggccattccaccgttctattaatccagctgcttcaggatgaaggggaacatggtaagaccagtgaattccatgagcatgaacccactgccacacttctttagctatgaaatgagtgccttagaggcgatgctgtgtggaataccatgatggtggataaggcattccgtgagtccacagatggtagtcttggcagaagcatcgcgtgcaggataggcaaacccatatctggagtaagtgtctattccagtgaggacaaccctctgcccttgccatgatggaagaggtccagtataatcaacctgccaccaggtagctggctgatcaccctgaggaatggtgccatatcaagggctcagtgttggtctctgctgctggcaaattgggtacccagcagtggccatagccaggtcagccttggtgagtggaagtccatgttgctgagtccatgtgtaacctccgtccctgccaccatggccactttgttcatgggcccattgggcgatgacgggtggctgggaaaagaggctgagtggtgtccacagaaagggtcatcctatccagttgattattaaaatcctactctactgaggtcacctgttggtgagcactcacatgggatacaaatatcttcacagtttttgaccactcagagaggtccatccacatacctcatccccgaatttctttgtcaccaattttccaatcatgcttcttcccgtgaattcagcccatgaatcagtatataatcacacatctggccatttctctgtccatgcaaagtgcacaaccaggtgcactgctccaagttctgcccactggaaagatttcccttcaccgctgtccttcggggtgtcgtagaaaggggctgtagtggtgccactctctattttggggtggtgtctgcatatcatgcagaactgtctgtgaaccagaccctagtcttctcttcctctgtcagctgatcatagggaactccccatgagactattggtgcaggctgggggagagaagacagggtggcagagtggagaccatgggcatttgagccatttcctcatgtaacttacttgtgccttcaggacctgcttgagcccgatcacgtatataccacttccatttgatgatggaatgctgctgtgcacacccagctttatggctagatgggccagaaagcatccagttcatgataggtagttcaggtcgcatggtgacttgatgacccatagtcaaatgttcagtttctgccaaagcccagtaacaggccaagagctttatctcaaaaggagagtagttgtctgcagaagatggcagggccttgctccaaaatcctagaggcctccactgtgattcacttatgggggcctgccaaaggctccaaacagcatccttatctgccactctcacctcaggcaccattggatcatacggcccaagtggcagagcagcttgcacagcagcctggacctgttgcagagccttctccagttctggaccccattcaaaactggcagcctttcgggtcactcgataaatgggttggagtaacacacccaaatgaggtgttgcctccaaaatccaaataggcccactaagcgttgttgtgcctctttcttgcttgtaggagaggccaaatgcagcaacttattcttcaccttggaatatctcgacaggccccataccattggacccctagaaattttactgaggtagaaggtccgtgaattttagtcagatttatttcccatcctctggcacgcaaatgtctcaccaataagtccagtgtgtttgctacttcttgttcactggatccaattggtataatatcatcaatgcagtggaccagtgtgatgtcttagggaagcgaaaagcaatcaaggtctctctgaacaagattatgacacaaagctggagaggtgatataccactgaggtaggacagtaaaggtatattgctgctgaagacaaattgcttctggtgggccttgtggacaggaatggagaaaaaggcatttgccaagtcaatggccgcataccaggtaccaggagatgtgttagtttgctcaagcagtgaaaccacatctggtacagcagctgcaactgaaatcaccacttggtgaagcttacgataatccagtgtcattctccaagatccatctgtcttctgcacgggctaaatgggagagttgaacggggatgtggtgggaatcaccacccgtgtgtctttcaagtccttgatggtgacattaatttctgcaatccttctggggatgtgacattgtttttgatttactctttttctaggtagaggcagctctaatggcttccactgggcctttcccaccatagtagccctcgccctaccagtcagggagccaatgtgggggttctgccagctgctgagtatgtctatgccaattatgcattctggcactggggaaatgaccacaggatgagtctggggacccactgtaagtcggacctgagctaaaactccattaattaccatacctccataagcccctacttcaactggaggaccacagtgacgttttggctcccttggaatcaacgtcagctcagagccagtgtccagtagtccccaaaatgtctgatcatttccctttccccaatgcacagttaccctggctaaagtccagaggtctcattggggaaggatgggagaaagagtcaccacataaattgttcgtaatgtagtggggtccttcctcaaggggacctggcctcctcttcattcaagggattctgggtctgtaaactggctcaagtctggaaattgattgaggggctgtgattctctgtttttataattcaaattagtcttttgtccattcgacccagaagttttctgcttatataaattcagtaggaaggcagtaggcttcctatcgatttcccttctaggaacaccatgattaattagccagtgccagagctgtacacgagtcagactattctgattgccgctttgcctctgctgtccattatggtagctacgcacaccttgcctttgacggttgagtgtcatcacttggctcctgccacctcgggatccaattattcccatcatatttaaattttgtagttgcgtgactgcagttcccaccattagatctgacatacagggaagaacaattacagggctcttcaaagatgcaggtgctgccctcacgaatctattttgcaaggcattggttaagggtatgtcttctggaccctcccagctgggatgagtaggtctaaagtggctaatccactccaccatcccaatctccctaagcctttggatcccttcctctacattaaaccaagggagatcaggcatttccagctcactcccagtgggccatcttttaatccatagttcagctaaccaagcaaataaactcttagaacctttttttaactccccagctgcaacattaaaagcagagtccctacttagtgggcccaaatcaataaattcagcctgatccaactctgtgttctttccaccattatcccatacccttaatatctattcccatgcctgttctccaagatttctgtttatatcaattatagaactcaaatggttcttttcgagtgtagcgcacctcctcatgggtcacattctcaacctcacctctaggggcctgctgggactttagtgataggtctagaagcaaacaggggtgtcgggggtggctcctgagaagaatcaacatattttgcctggcaattgcctcaggggaggccatcactgttgcctcaggcagcacagggtttatctcctcagacaaaggtggaaaggctgatggcagccatgggtcagggaagggatgttgccattacaggggatggggaagctgttccttctggcaaaaaaggttcatcggagtttacaaactcagtgtccccagcttcatcagggttctccctcaccgtccccattccaagttgcagggtcctattcttttcgaatcaatgccctcactttaacagtagacacctggcgaggctgtgcatgcatctttcattgaaggtcagcccctcgcatgataagagcatgtgtctgtttttccacaatttcagctctttctctacaggagataagactctcactcagggcaatcttagcagatttgaggctcagtatctgcttttgaagccgggagacagaatccccaagttcatcattttctttcatcactttgcccactgaacttaggagcaaccaaccaacttcattatattccttggttttccacatatggtcaaaggtattatgtatagagtcactaaactccttgcctctcatgagcagtgaatcaggagtgtcaaatgcatttattttgcataactctctaaatggtttatgccaaggactatcagtgttctccatactatgagaagtggagtccttagcattttggagtctaatcatattaagcaggcaactccagaaacctcaacccacaaaagaacttcatccttaatattctgttcctctagaaccactctttgtaccaaaatctgtattagggttctctagagtgacagaactaataggatagatatacatattatgtgtgtgtgtgtgtgtgtgtgtgtgtgtgtgtgtgtgtgtgtgtgtatataatatctcctatatatctcatatgtatatatcatatatagagatccattatatatatatatcctatatctatcctatatctatatcctatatctatatctatatctatatctatatctataaaggggagtttattaagtattacatcccacaatcacaaggtcccacagtaggccatctgcaagctgaggagcaaggagagctggtccgagtcccaaaactgaagaacttggagtctgatgttcgagggcagaagcatccagcatgggagaaagatgtaggctgggaggctagaccagtctctccttttcacgtctttctgtctgcttaatatttgctgacagctgattagattgtgcccaccagattaagggtggatctgccttccccagcccactgactcaaatgtaatctcttttggcaacaccctcacagacacacccaggatcagtagtttgtatccttcgatccagtcaagttgacactcagtattaaccatcacagttactatgtacggatttgcctattctggacatttcatgtcagtgggatcgtagaatatgtggtcatttgtgtctggtttatctcagtataatgtttggagattcatccatgttgtagtgtgtatcagtcattccttttcatgtctgaatgctattgtcctatgggaatggactgcgttttgttcatatcctttgatggacatgtgggtggttctcctttgtgattcttgtaaataatgctgctgtgtggacaagttttcaattctcctgagtattttccttgtgtttcaagctttttaacctcagtgccccaggcatagcgcttgtgatttcctgagcacatgggtggcgcatccctgatgaatcaaaagaataggattggtcattttggcttcacggctgttgaagcaaaattaaaactcacaatttcaaaggtcataggatttttgtcctgaccccggtgggtgtgggcccctgcagggctccgacagaggtggtcagcatgtctgctgagccttcaggaagacatgcctggtcaccggcatccttgtggtccttgtggtggcagtttgtggttagctcagccttaccccctgctgctgctgctgctgctgctgctgctgctactttctgagcaggagcatgggagtctttcaccctccctgcgaagtggacatggggttgattctggggttcagacagcgagcggggtccctgtagcccaagggtgatagtgctcgggacggtgtccccccttagacatgagctgctctcttgtcatttcccactccttcacttcccagcaacaacacagcttcagaccaaaatcaaaaccttcacctcttcatcatttctggttatatttcagaaacccgtgctatagggggatccctcaacaaacttaaattttccagatttaggggacattggcagtatcttcatcataacattgtagggtttgtaaggttttctgttgaatatttttctttttcttttttttaagagacgttgtcctgctctgttgcccaagctggagtgcagtggtgtgaccttgcctcactgcagccttcaattcctgggctcaagtgatcctcctacctcagcctcctgagtaggtgggactacaggcacccgtcacccatgcccagctaatttctgtattttttgtagagacaggatttcacgatgttggccaggctggtctcaaacccctgacctcaagtgatccacccacctcggcctcccaaagtgctgagattataggtgtgagccaccacacccaacctccctctaactttttttttttttttcagtatgtctaaacattttggaattgtaatttaaatcataagggcaaaagctgaaaattaatgcttaggtttactagtaagtgcacccttccctgtttcccccaaataaaatcagtttattttttaattgtaccccaaagcaagttctctcagtacgaagcaactactgcgtacacacaaaatggttgttaatgtaataacttccctggctcacccaacgtgcagtgcacacgacttcaaagactacaatttagggcaagtatacatgaaatgagaaaacaactctctaagtttcaaaacctgctgttaaattatttctaggacactcaggtcatatttacttctcagtaggatgttgcactgtcatttggttatcagtctacctcgcagtgtacattaccagatgccaattggagggactagagataaaacttatgtagtactatttcttaatgggctgaataaggtaattacaaataagtttgccttacatcctgttgaagacctctttacagcctcagtacctaacaatatctagcagcctccaagaatgctcatcaggtgaaacgatgatgtaacatttgaaaatggagccagatacttcagcttaagtcattcagagccaaatatctgaagaatggccaaaatcaaatctttatttttataactgtataaatgtgatccaaatgtgtccaccaccagtttttcaaaaagaaacatgctataaataagcaaactacatctgctcactgatgtgtgtatggactccctggatgtctcattgagcttaattacagaccactcacagtaatggatttttagtgtatagtgtagcttgatgttaagccattttagcttttgcgcatacatgttgtgctggctggtaacggagaagaatttgcagcattacaatgttaagctaggttgtatccatcccattaaatggcatcaatatcaatgtcatcatccttgttgttggactttacagtttcaactttaggtacactggcagtcttctaatacaccacctcaatgttctcatcttcatcttcttcaccaccagaagattcttcctctgcctccattttataaatggttctactttgacacgaatctctttggcaggttcttttgagacatgtttcttaaaggcctttttccgaccagctgatgacgacctcttcttctaaaaaatctacatcatacatctccttcaagatatttggaatcttagagataagctgagcttggtgcattgctaccccacacgtaaagccatgaagaaggtaccattgagcttttttgttgttgtgacaaaatcataagaaatggtgcctgtatttcttatgtgttctctaatctcctctttaaaaagaacttcagtcagaacaagagggcccatggctttaacatccagtccttctgcttcagtaacaatttctttgtcacataaatcaatgataccctcttctttctttttcttcacaaaatcaaacaggatgttggcccgctcctcaactgttttttccaaatcatcatggagtatcagaacttttgcatgatcactgatttcatccattctgcacctttgagcttcctcagttgtatcttccccccagtcatcctcctcttcttccactgtatgtggaggagggctaatttctttggtggtggtgtctcactgctggatacggagccattttccttgtctttgccctttatatttttcttttccttttctttctttcctgtaccactgtcactattctcaggtgggtttttgagaatgaatgtgcagagtttatgatgtgtgtcaagcatgcctcgatagccacaggctttataagaattacctattgtttgctgctttggcttgacatgcatatctgtttcaggattctcacattcaggacagagaacaaattttttaatgagtccatccaatatgtcttgcagcttattggcctcctgagatccattcacaatgtaacaatgtatcccaccaaaatacttggtgggataccttggaggccaattaagcgcctttgcagtgtcagtcatgttgactataactgtcttgattccatttcctttgccctcaaccttggcaatcagacagggcatcttgtaatagaactggtctgatatgctggggttgacgttgacagacattttggcttattggtggctttatcaataagatgaagagatctttgattgcagcttttttatatcttctgtctggagaagaagggatgacataaacaactgcaaaagttctcggtctctaatgtgaaaacattttcaccactgaggctgtaagcgtcttgcttgtatgctatgtttccccaatacaggtactaatggctgcgcaaaagctcttctggtgaaggcctccctgctctcccacgcttgaaaagcgctgtccttcatgcttccctgtcaccttgctcctagcaggcatcacgtcgagtccaccctgccagtttatctttttttttttttttttttcttgagagggagtctcgctctgttgcccaggctggattgcagtggcgtgatcttggctcactgcaacttccgccacctgggttcaagcgattctcctgcctcagcctcctgagtagctgggactacaggcacctgccaccacacccagctaatttttttaatttttatttttagtagagatggggtttcactatgttgtccaggctggtcttgaactcctgacctcaagtgatctgcctgcctaggcctcccaaagtgttgggattacaggcatgagccaccgtgcctggctccctccacctttaaaattttttttttttttcagattatgtttttcgagcctcaagatttattttattgcagtattttttttttttttgtaaatatgaagagttgtccagtagagtctcatcatatgtcgactgaagctggcaccatcctatggcccacagaggcttctgtaactgggtcttcaacatgtggccctccctccatcctttcccaccctctttgctccagccacagccagcttccagcttctagaagcagcctgcattcctcccccacccttttttaaatagagtcttgctctgtcacccaggctggagtgcagtggtacaatcatagctcactgcagtcttgaattcccgggcttaagcaatcctcccacctcagccctcccaagtagctgggactacaggtgcaccaccgtgccctgctaattaaaaaggttttttttagagatgagttctcaccatgttgcccaggctggtctcaaactcctgggctcaagtgatcctcctgccttggtctcccaaattgctaggattactggtgtgtgccactgtacctggccttcctttttcttttgaaaaaatccttaggttttaataaaattccacgtcctccattctctgaaatctgtatgaagtaccagaagtctcaatttgacaatagacatggtcaggatatttctaatgtttggatgatcctctgcaaactagaggccagcagacttctgtaaagggccagagagtaaatatttttggctctgtgggccaaattactcctctgtgctgtatagcatgaacgctgctgtagacagtatgtaaatgaaaggattgtgtgccaataaatctttatttacaaaagcaggcattgagcagtaattggcatcctggctggggcttgctgtccttggtaagcagtggttttcaaagtatggttcccagaccagcagcatcagtatcccctgggaacttggtagggatgaaaattcttggaccccactctagacctaccgaaccccaaaccagaagttaggaatcatctgggtgatgctaatgctggctccacacagcagagcagttctctgtacaactgctctacagagatgtggcctgtctgccatttgtattctaattagcatgtgcaaaacctcggaatcacggttgctgggacccagggacctgaattttaacaactggctcagatggttttatacacactgaaatcggaaccagtttctaaagcagcacttctctgaaccagtagaggacgtgggggaggcgtcagggaagtttttcaaactacagcctgagcttgcttggggtactttgcaagaaggagggggtaaatgtggaaaatgggagcagttgtggctttttgttagcttattgtgaactctgcccctggtacctggtctgggaaggtggatttatttcttttctcctacatgtaatgcgtgttttgaaacccaggaatttctgaaattttaaagcctgttggttgtaataaatattgcaccccaccacatttgctaccacatttgcgaacttttatttagtatttgaagtgaaaacgggttgagaaatataccgtatgatccattggtatcaaatatcttgaatatgcaaatgcttcaaatgcttgaatatgcaaaggcagcaaaatggtggttaccggggcggagtgcagaggggagggtctgccagcaggcgtggggtttctgttggggtgatgaaaatgttctggacttagagagtggtggttgcacaactctgtgaatatactaaaaaccctttgattctatactgtaaagaggtaaattttatcgtatgtgagttatactcaagaaagcagttatttaaaaaaaggaaatgggtcgaggtgtgtgttcagccttattcttgaattgtagagacctcactgagaggaggctgaccctgaaggcccctgttagagcccatcctggggcagttcttcagtggccctgaattcgtgtcacagggatcatcactaagctgtgatttttggtgctggatctgacccaggagcagacaggcctgggaaagagtgtgtgttgtttaaggagcctcacctctgagtgggtgaaccccgattgagggagaaactcacatggtgttcctccagggcatgtagctggaaggccccctgggctgaggagctagtggcagcctgcaggttaggggaaggggggaggaggctgcagtgggggaggtgggcaggagccagggccttgctccagggcagtgggagccatggaagacttttaagcagggtgtggtggcaaagaccacttgtaatagaagggcaaatgggtacaggagttacagggaggaattaggaagccttgtcctaccagcagtgatagagaaaagttaagggatgcgagtggtaccaccacggcacagtatccgcatctggtgcagggatggagaatcctggtgcctgaacacacgtgtgcatctgtgcatgactgcttgcctctccctccctccatcccatctgcctgggggaggcgagggctgagcagggatcagtcctgggagtcctggctcctggatctgtgctcagtgccacgcaggtggcagctccagaaagctctgcggagggaatggccaaatctggtgcagaccagctcctctctgcccaggtgtggctaggctgcttcaacatgcttgcttagtgccaggaggaggaggaggagtgctcagtgcctccgggcaggagcggacctccctggggctctgtcccttctctgaggactcccagcaaacactggcagcgggggtcttcaatgcactgtcctaactgcttgggcaggaaatgaagcaatttgttggaaaaactcaattttgagaataagaataataattcttcttcttcttcttcttcttcttcttctccttctccttctcctcctcctcctcctcctcctcctcctcctcctcctcctcctcctcccttctcccttctcctcctccttctcccttctccttctccttctcccttctccttctcccttctccttctccttcttccttcttcttcttttcttcttcttcttcttctcctcctcctcctccttctcctcttcctcctcctcctcctcctcctcctccttcttctcttcttcttcttcatatttttagagacagggtctcactcttgctcaaactggagtacagtggcatgatcattggtcactgcagccttaaactcccaggcttaagctatcctcctgcctcagcctcccaagtagctgggactaaaggcttgtgtcaccatgcctggctaatttttcgatttttagtagagacaaggtcttgctatgttgcccaggctggtgtggaactcctggcctcaagtgatcttgtctctgccaatttcatgttattcttaaacataagattttatttgaatggtcaccataaatagatcttatttttgtagttatgtcttcactgcatgtaaaattgtatagtgtgctaggaaaacagaatcaggtagtagttacttctcccaggaagaggcaggatctatacgaagtcatttttgctttttgctttgtttttggtaataatcatggaattatgctccagatttacatggagaaacaacattttttttcttttttcttttttcttttttctttttttttttttgagacagggtcttgctcgtttgcccaggttggaatgcagtggcgcaatcacagctcactgcaacctccacctcccaggctcaagtgatcctcccacctcagcctgctgaggagctgggactataggcatgtactaccaagcccagctaattttaaaattttttgtagagacaaggttttgccatgtttcccaggctggtctcctgggctcaaagtatcctcctgccttggccttccaaagtgctgggattacaggcgtgagccactgcagcgtcccaagaaataacatttgggtatgaagtgaatgaggctcgtttacattccaggttttcccccaaatctttttagtttaaacaacagcttaaaaattaaggtcggccgggtgctatggctcacacctgtaatcccagcactttgggaggccagggtgggtggatcacctgaggtcaggagttcgagaccagcctggccaacatggagaaacctcgcctctactaaaaatacaaaaaaaaaaaagctgggcgtggtggcaaatgcctataatcccagctactcaggaggctgaggcaggagaaactcttgaacctgggaggcggaggttgcagtgagcggagatcgcaccattgcactccagcctgggagacaagagccgaaactccgtctcaaaaataaataaataaatagaataaaatacaataaaagatcatggatttctagtaagagaagagaatatgtaagctggaaagcataaacctagaaatcttccattccatagattttgcccctctcttcctcccctccccacaaagaaataagtcatttggagcaaagcaattgcttaaacttttcttagctggtttccggagctccctgggaagaatgagggtggaaagctggaggggcgttctgggtattggaatgcaagccagtggatctgtagcccgctgtgcttctgggagcctgacacgacacacaaccggcacacaaccgttgtgcccttttgaactgtgcagggtcttagctgggctgggcagtttgacacggctgttttcaccatcaggacgttcacttatggttgagtacctggcaagggtagggagagaggaatgttcccagccatctcctgcgggacacttgggcggctttctccctgggacccccatctcgagatggcctcgggattgtggagggggtggcaggggtgctgggtttgctttcatgaaagagcaaagcagtttcccttctacttatcttgttttcagatgtagtggaataagccaggaaatatttctcctggatgaaaggtcattcttcttacattggaagctttggaaaaatctccctaaatatcaaaatacaaaggttatggaataatatgtgcttcgaatagcttaagtggttaaaaaattctctttgcagctcaatattaaaggaaaaataatagactgttcttggacaaaaatgaaagggatcacgaagaatgtgtttccagccagcttcctgcactggggttattgcaccaggactgtctccctagtagaggccctgtttactatgttgcttagtccttgcttcacaaaagcaatatttgaaccaataatcccacaacagcatgacattttaacttgtaagactttgggttttcacaacatggtgggagtctgttttggtattttgttctataaattcagttggggctgacaaaattaatgaactggcattttagagaaagtgacattgtaacttcccctcctcttcgcatgtttacatccacactgataaagatgcaatcttgtctgtagctcattctccaggaacttgagtgtcaaggacagtctgcacggcccttgggaaatgggcattccctggcattgagttgttaattggacgctgagtgctcgagctgcatttatggttccatatgtgggtgtatgtttgtgtttcagtgaggaagatagtagctgcttccctcccacagccttgtggaccctggctgcacatttgagttgcctgtttgacgctgtctgaccctttcttagccagtttctggagctccctgggaagaatgagggtggaaagctagaggggagtcctgggtattggaatgcaagccagtggatctgtagcctgctgtgcttctgggcacccaacacgacacacaaccgtgtgtgttcccacagaacctctgtgtgtgtctgaagccctctgggtgactccacctgtggccacagttgggagcaagcctgcctgggcctccgcctcctgcaaatgtgatagtccccacccagggtgggtgcatgtgcctctcacggtagcaactccatggcttgcctgaggtgggccaggttcttcgggggctaatgtctcaccgccctgtccagttctggttctcagtgaatgtgttatgccatcatgacctttgtcactttcttccccttgccttgtttttgcacattggaatttgcaagcgggtctgtggtcatccgaagttgtgctcttcatgcataacctggcctccacgcctcactgctgggctcggatgacacaggtgggagacttctgaatattagaagtttattggaacatctaaattgtattctaaataacctttttctttttttgacaggtatcattttcctttttttttaatctctatttctaagaataactttatcttcagctcttatccatcatttaaaaacaataacaaaagaggctggatgtgatggctcactcctgtaatcccagtgctttgggaggctgagctgagaggatcgcttgagctcaggggttcaagagcagtctgggcaatatggtgagaccccatctctacaaaaaaatacagaagatgtagctgggtgtggtggtgcacgcctgtagtcctaggtgcttgggaagctgaggtgggaggatcacttgagcccagggaagtcaaggctgcagtgagctgtgattgtgcctctgcactccgtccagggcgacagagagctaccctgtctccataaaaaagaaaaagaaaaacaagaagaaaagaaaagattactatgtacattctcatctttcaaagaacgaacaagatttgggaaaatgcaccaaggctcaaacgcttttgaaaggtggacagtggtagagaatgttgagtctttgggcctctggtcagcttttaaggccagggtgaaaacagacccttggaaatgttactgtgtattcagttaaataaaagaagggggatgactccattcctccagtgcagtggtgaaaccttggctgtgctccctgggggagctgcgaagcgctattgatggccaggctgcaccccaggccagttagtcaggagatggaggggcaggggcaggtattggtgattctaaagaacaccaggagagtccagtgtagcctggatggagggttatggtcttacatgttagccttgacatttttctttttctttttttttttttttttgagacagggtcttattgtgtcacccaggctggagtgcagtgacgtgatctgggctcactgcagcctcaaccacccaggttcaactgatcttcccatctcagcctcccagagtggtgggattacaggcatgagccaccacgcccagctagccttgactcttgttggcaggttaacagacaggcaccaagcattctctgcaaagctcatggtgaacattgagtccccccggccaggggcctgcctgagtttaatgaatgggtgtgttttctgagctcgagggggccacattggttctctttggtttgaggcgagggagcacgtcaacctttggtcaggctctggtggccaaggtgtcacaggaagggaaaaggtgtagtctgtgctgaggctggggccgagggattttcaagcagaaggagctccagggagtatggaatgcactctcctgccttggggagcagggagaccaatagacccaagcagttctgggaaagtaagtggtgctgctgtgtggggaggtggagcaaggaggagggaggaggccttcctccgctgagagaatagggtccttccgggtcggggtggttgggctgcattgtatggggtactagcgaaggacctagcaggtgccaggctaaatgctttccagcagggcttctctaagagtgctcttcccatcagcagcatcagcttcctctgggagcttgtccaaaatgcagaggctcaggtcctgccccagtcctgccctttaagggcagggtttcacactgctataaagaattacctaagactgggtaatttataaagaggcttaattgactcacagtttcacttggccgggaaggcctcaggaaacttacgatcatggtggaaggggaatacgcacatcttacgtggcagcagtcgagagagagcaggcaagagcagggaaaactgccttataaaaccatcagatcttgtgagaactcactatcacaagaactgcatggcgggggaatgcccccattatccaatcaccttctacctggtccgtcccttgacacatggggattatgagaattacgattcaagatgagatttgggtggggacacagaaccgaaccatatcaagggccttctcgaaggatgcttctgatcataggctggtgcttgggaacctcagcctgatagactttctcttatccattcctcatatgtgttccagggaagaagttattgttcttcttcttattattattgttgctttagtgacagagtattgctctgtcagagtaagccttacccaggctggagaccagtggcatgatgttaactcactgcaacctccaactctcccacctgagcctcccgggtagctgggactataggtgcctgctaccattcccagttaatgttatttttttttgtagagatggggtctcactatgttgcccaggctggtctcgaattcctgggctcaagtgatcctccagccttgcctcccaaagtgctgggatcacaggtgtgagccactgtgcccagctttcctgtctgtctatatctgtctatctgtctcttcatccacacatacaattttacgaatggcaaagcaacggttatttctattttgaacaggcaaatgacacctcagcagggtgtagcgtaaggaccatagcgctatctttgagttagtaaaccagatgctaatcctttgtgttgattgactttggatttaaaacctttgagcacaattttcacatatctgaagttgggaaggtaatgcttcctggggttgtttgtttttgtttttgtttttgttttttaaacagattctctctctgttgcccaggctggagtatagtggcacaatcttggctcactgcaaccttcacctcccaggttcaagtgattctcctgcctcagcctcctgagtagctgggactacaggcatgcgccaccacccccggctaacttttgtatttttagtagaggcggggtttcaccatgttagccaggctggtctcaaactcctgacctcaggtgatgcacccacctcagcctcacaaagtgctgagattacaggcatgagccaccacgcctggaccctggggctgagtagctgtcgccagtctacacatgccagctgttaccagcagcactagtcagagaccccacttttccagtgcccttgcagtaggtgtgattgctttgttggctaagagctgaccccagaggtttgtggtgacaaggaccagagccatcctttggaggtggagttccaatgatgcccaatcatgatgggggccgctgttgatccgtacacactccgattccttttcagcccttagggtggcagggacacattgagattctagggccaagagactgggagccagtcctagtacaaggcatttttttaaatatatggaaacaaggatggtgaatctggaagttgagaaattgcggttgcctgaaggtgactcacaagcgaaggtatttctaagccagaagaaagtatgattcagattgaaaacagaactcacacctgccggttgcggcagagtgatctgaacatgctcattacgacagtctagttggggtaggtacaaagcttatttatcatgcatgctttcaggatgagaaaaccaagggctcagatctaatacaatattattcaggtttcaggttcagttgatgcttttaggagagcattttggcccagttttttttatttttatttttattttttaagaatcattagctaatggtttcagaaaatacattagattatttcagattcacactggcatgtcttgggctctgcaagtctccctctctcacacacagtaagaaggtggccttctgcagtccaggaagagacccctcaccggaacctgattatgttgccatcttgatcttggacttcccagctccaggctgtgagaaatacgtttctttctttttgtatgtgtgctgggattacaggcatgggccaccgcacctggcagaaatacgtattgttgctattccctgctcccctctgcccctggtagcctctattccactttctggttctatgagtttaactgcttgaatctctttttgccatgtacacggagcagggggagtgctggcgcctggatggtggcctgaattttcttgctgcctagagtcgctgatccaccacagccatctgtctggaaagtggggtcagctgaattggaagtggcatcctgatgaatttccgacatagagcttgataattcttatccttcacccaaagattaaactggaagaaagcagcttgtggctaagaaaattgatcagtttagctgttacagggtctcaagtgaacccctggtttcttttttttttttttttttttttttttttttttttgagacagagtttcactctagttgcccaggctggagtgcaatggcgcgatcttggctcaccacaacctccacctcttgggttcgagcgattctcctgcctcagcctcccgagtagctgggattacaggcatgcaccaccatgcccggctaatatttttgtatttttagtagagacagggtttctccatgttggtcaggctggtcacgaactcctggacctcaggtgatctgcccgtctcggcctcccaaagtgctgggattacaacccctagtttcttagataactgtccagcctgttggcaaaggccagacattaacaccatgtgttgaatgcatgggtctcacgagaggcatcttgtgagttctgagtttaggcagaaggcgagagaagtcagattctgttgtgcgttagaggaaggcttaaggttgaacccatggaactacacacaggagagtggggagggaaactgaggaaaacactgacttttgtcagaaaagactgtttcagaggggaaaccgaaatagctggttagtgccgtagatgtggtttgtcaacatggcactatcgacatttggggcttgatgattctttgctgtggggacttttctgtggattgtaggatatttagcaacatcttggcatctgtctccaaatgaggacaaccaaaactgtttctagacattgccaagtgtctaggggatggggaccacagtcactgtgtcttggtctgttcaggtttctataacaaaagaccatagaccagttgacggtggctcacgcctgtaatcccagcactttgggaggctgaggtgggcggatcacctgaggtcaggagttcaagaccagcctgaccagcatggagaaaccctgtctctactaaaaatacaaaattagccgggtgtggtggcgcatgcctgtaatcccagctacttgggaggctgaggcaggagaatcgcttgaacctgggaggcggaggttacggtgagctgagatcgtgccattgcactccagcctgggcaatgagagcaaaactccatctcaaaaacaaacaaacaaacaaaagcaacagacatttgttgctcacagttctgggggctggaaatccaagatcgaggcgtggcagattcagtgtctggtgagggcttcctggttcacacagtgccttcttgctgtatccatgcatggtggaaggggcaacagagctctctggggtccctttaataagggcactaatcccattcatgaggctccaccctcatgacataatcacctcccaaaggccccacctcctaacaccatcaccatgaggatcaggatttcaacatatggattttgtgggtgggggaacacacacattcagtctgtagcacacgccagttaggagccactgctatccactgtcagattctccctaatgtgtcatccttcccttggccttagggctgggacccctagggaaccttagttaaggtcttcgcaccttcttctttcgtgtgttctctttgtgctgaagtttgcttcaggtgtttaagagagtctggtccttgaagaggcaggatgaccttggcaagacctggaggagccaggggtgcctgtccagaggcagggagctccttaggcctgcacagtggggcttggccagggatccatcctcaggacttggttctgctatgggaggtaacgcccaccctgtgtctctctagcccgccgagcccctccctctgcagcacacccctccttgctggtcttgcactttgtgtttgtcagggagcatgactaggttggtggggagtggaaaggaaatctccagtcctgagggatgctgtcccgtggccatctcttggtcgagtcttttggaattgtgtgctggctccctcgaagtagaatgcatgtgaccatgtggcacatgcaggcttagtagttaggaaaccgtttacccagtaggcacatgggatagggagcgggcacagctagagctgggagtgccccagcacactagacgaaccagcaggagcctgcatatgaaccggctgagctccccagctgaccgctgagctcacttgcaggtcaatgtgtcctggggcttgcttgttgaacactaacgtgtgtgcaggttgcaggggtaagggtggggggcgggtgcacctcactctgagcccgcttctctgatggcccctgcttgctggtctaccaggtgttcctctggccaaggtcaaaacctcagatatttgatatttcttgttttgtgtataggaagtactagaaatctactttgtaatgggtcagaggaaggggaaggacttatttgtgttggtttttgaagcaggaagtggccacatgcaaaggttttcctgtgactgggcagtcacagaggggagatgagatgggaggaggagttgccggcacaatggaaagtgctttacttctacttaacaaatgtcttctcgcgtccttgtggagaaggaaaacagcaggtggccctgggactctgttgactaggaaatgacagacggaacaaaaccgcagcctcagagcaagcatccctgagccccttcactgtctgtgtgtgggaacacattggtcctcattccgtaacgggaatctgccagttgtggagcgggcgttttattacctgtgaccgccccatgttgaaatgaatacactttttgtccagttttctctctggctcttgtgttagtgtagtgacccgcagtctctcctctccaaggcagacttccacattttcccaaagtgctggaaattctcttctcctaggtcatcatgaagaaaatgaatcaaaatactgggagatgtttgctctgcaggctacttttgtttaaaactatattatgaatcactgtacacattttcagctaccccacccctgcatcggacctcctaattagggacctcataactaagcacttagttactaggacattgagcgctgaaggactccactgacaatgaagagacacacaagtagactctgtgtgtgtgtgtgtgtgtgtgtgtgtgtgtgtgtgtgcatgcacgtgcacacatgataacagaattccagacaactccagacagccagaactactttggttgcaagtgacagaaatacagcctagaccattagcttccgtgggagagggactgcattaactccccagctagaaagtctcgaggggcttcaggcatgctggaggacccactgtgtctccctgtcccaccccactgagatccgacggcctccttcctgctggcctagttctccagcacatttcccacagtggccacacgtgtccctgggcttgtgttctacagacctgcagcctcaaaggaaggatatgttcctccctgacaagcctcgctgaggttcccatctacactagtggttcacaattgggagtgactttgctccccagacatttggcaatgtccagaggtatttttggttgtcttaagatggggggatgccactggcctttgtgggtggagagcagggatgctgctcaacatctgccagtgcgcaagatgccccccacagcaaacgggggtccatctcagtgtggtggtggtgctgagccaagagctgcagcgctggacctgtcaccctatcccaggactgtggcccccagcatgggttgagtcccatgcaccaggagagtgctggggaagcctgtcaggaggaggtggtgtcctccagagggaggaatctgctggaagaaaagagaggctcagacactccgtgtggtgttgcatgtcctccagaatgttgtgcgcatgggaaatgctgtataggtgcctgcagaaccgagccggcaagacagggaggcagagctccctccaaaacagggagcagagctcggtgctcactgctttgctcaggtgttgccaaggcagctcgtggaacttcacctggaagaggtcaaggggaagccatgggctcattgcgaagtaaattggtgttgctcatcagtgctcttggccattcctccccagtgctctttctccaccttatttatttatttatttatttatttattttctttgagacaacatctcacaaaaagtaaaaaaaaaagaaaagaaataaaaagagcatctcactgttgcccaggctgtggcacaatcatggttcaccttttaccttgatctcccagggtcaagagattctcccacttgggttttccttgtcagggagctgagccaggtagagaggggtgtttgcaaggtgcactgcccgtgcctgcaggatctgattactggtgcagagcccatggtttagctttgtgctggctttgttctaaaacttcacccagcatctgccactgtgcagaaacaggtggcgctccatcaggaggtggtgctgtcgtgtcctacccaaggtgccagtcaggggagtccctgttcatcctcattgattctgatgtccagaatcttacagagaatttttttctttatgtaaagtaggttttattgtgttcaccttgaaaacaactcactgatgggaaaaaacacactgacagtgttgactgcaaatagagtgacctcatatcatttcaaactgggagtcaggaaactagacctgcagggcagagaacctgtgctttgcagttgcctggaggaccagaagtccacaggaagaaagggccagttgaatatatgcacggacagatgtgtatggggcaaataattcccggggctctgtctccctctcttccctcctccctgtccagcagttttaatgtttcgagccttgctgttctaaggaaggaagcaagagcagcagcagcgtcatccccttggaagcacattagaatgcagggcaatggggagaaaccatgtggctgcactagcgtttaggaaaacgttaattcttatgccatcttacagggcctggctacaaaaagtaaaatgaagaagaaaagcagcattagcatacaccattgtatacctcaaagaagggttgtgtttttagcaccagcgtgggccaggaggattctgattttagaaaaccaaacttttaaggctttgggagagcacctgccctgccctaggggggtactgggtgcagaagcccagcactgcttttgcccgacctcactggctctcttcatgtttttttttttttttggttgttttgagtcaggctctcgctctgttgcccaggctggatggagtccagtggaaccatcataggtcactgcagcctccaactcctgggctcaagtaatcctctcatcactggagtagttgtgtgccaccacgcccggctcagttttctgtttttgtttggaggctgaacacagaggttccctgaagaaagttggttggagctggagttgttctagaacctctcactgtcaagtaaagaaccctgctgagcagctgagcctggaagcttcttcgcacccctgagcacctttcctgagccacgtacagcccacctgaaggcatctgcacacctggagagcggggaggggaggggcagcagacccgggcaccagatcagccctggcccaggcccaggcccaggcccaaggcagccgtctttgcacggtgcagtggggagtggaaaggcccatgtcccctctcccagctcctctttttagtggacagctgcccttgggtaaaagtggaccatgctcagcctcagttttctctctaaaaagaggggaacccctggcagcatagtgtctggagtctgcagggcctcagagattgctggacacatagacagcgctcaacagataggaactggaggtttctaagaacatttctgggcccggtttagcatctttgcaatgtctgtgtgccctcgcttctctccctctctagctgtccttcagcctcagcctcagtctaccccccagcttctctctctctctcttttctccctctctaccccctccttctcccttctctctctccctttccctcccactgtttttcttttacagctttatcgagatatgtgattttctttctttttttttgttaagagacagggtctcactatattgaccacaccggtcttgaactcctggcctgaagcaatcctcccatctcaacctcccaaactgctgggattacaggcgtgagccactgttgccggccaatttctacactataaaattcacccattttaagtatacaattcagtgatttatagtgagttcaaaggtgtgcatccttcatcatgattcaattttagatcctttccatcacccccaaaagattctttttattcctttaagccatcccttctggttcccaccacagccccaggcaaccatgaatctcctttctgtctctggacttgcctcatttggacactccctgtacatggaatcctgcagtatgtggtgttctgtgactggctttttgactccgcatcatattttcgggattgatccacattgcaggtggtatcggtactccattcccttccggtgccaagtgctggtccttggtgcagactgaccgcatggtgctgaccagtgtgtcagctgatgcacggtctcattgctttcccgtgccaccctgacaagagtggttcccacttttgtgggcacacgggagggggtctcggctctggaagtgaccagctttgtggtttgtggggaggctggtcgcataagtccttagaacatcaactgtcacttgggagccgggattgttagcataggattgttcaaaaaatctaataagccaaatattttaaaaacgtgtttcatgttgcctctctctgacctcaggaagtaagtcactgtcaattattgtcgtgtgagcaaaaatctccagcttccttcaactgacagttcaagggatagaggcttctagaagcatgttctccatgtggttctcctgatgatgaaacgtgtggtgtgcacatgtcccatcctgccctcccgacagggcggcatgcggaaggaacataggggaccagccctgttttggtggcggggaggctcacaggagagtgggcgctgggctgtgctctgagaccgttccttgtcttgcttggctttttctttggccaagtggagacagcaccaggtggccagactgtgttgggcctggtcgtgtgcttgatctgctgtactggggatgtcgcctcatacccctgtgcccagctccttgcggctgggtgggtctccttcaccctcctgtccttgctggctcagtgtttgtgtgcctggccaatataatgtgtggcaggttcctcacatccttcttgggccaggcggggtgccttcgctagggcactgcagcctcagatggtggtagcacctgcccccatgtatggatcaggccactggggcatcggggtcaccattagtcagcagaacagctggaattgggtggtcctggacatttccttgggaagcaagagcactgagtaagctgaagacttaaatcaggagtttttctgtgtgtgtgtgtggtttttttttttttttttttttgagacagagtcttgctctgtcacccaggctgaagtgcagtggcacgatctcggctcactgcaagctccgtctcccgggttcacgccattcttctgcctcagcctcccgagttgctgggactacaggtgcccgccaccacgcccggctaattttttgtatttttagtagaggcagggtttcaccatgttagccaggatggtctcgatctcctgacctcgtgatccacccgcttcggcctcccaaagtgctgggattacaggcatgagccaccgcacccggccttaaatcaggagttttaaggtcacgagctggctgggattgggttgttgccaacacccacggcagctaaaaactgcttaagaaatgcctgcttgtgggacttgcagggagcctgggaattcacaacccctaccatatagtagatcaagccttgactactaaggaaggaggggttatggtaatctgcaggaaagtatctcagtagtgacgaactcatcatagtatgtcgtatagcctttgtttcttctcaaaacttttacagcaagttcaggatggcttcatccagacacccgagttaagcaagcaagcaagaaacaaaaagccttaaataagagaagttgaagacagtgtgccccttcgtgcctgaatttggctaggaaaacattggcatgggagcgccaccaagggctggcacattctctgggccaccttcagaggtttaacttctgtgtgagagaaaccatccactgggatgcagcttttacgccacatactgccggattccacgtacagggattgtccaaaagaggcaaatccagagacggaaaggagattcgtggttgcctggggctgtggtgggaatggcttaaggaatacaaaggatcttttgggggtgatggaaagggactaagattggaccctttccttccctgtcgcacgtggaaggaaatcagaaaccaagcaagagagctgggggtatgaaaggaactgtgtcattttcttgactgaaatttcaccaggtggcactgggtgttgagatacatatcactgagcaatatcaggtcacacaatacaggagtattgtttctgtcacttccgaattggtgtgcttgaccccaacagctattttgtatgcattatgtgggcaaacccaagtgggtattgttgggttttcatagcaacgaggcagcagggcagagacgcgtttttttaccatcaccctctgtggtgtgggtgcattatgtctgagccattggtcatcttttcttgtcacccacatctccctgggtctggaatctgaccagaaaggaagccgcatttgctcatctgacaagtcctaaggtcagagagctcccgcctccatgaaactatcactgtggggcagatgatgagcaaaccacacacccgaaacatcacacatgcgcccccttgccatcttctttctcctgcctgtgtccccagcccaagcacggagctgctttctgtccctttaggtcactgtacattttctggacttgtatgtagatggagtcctgcagcaggtgctcccttccacctggctcctatctcttggaataaccattctgagatgtgcccgtgttgtcagatggatcaagagctcattgctttgcattgctgagtattagtgcagtgttgggtagcaagttacatgctggtggcattttgtgttaatattagaggctagtttttagaaaaccgttgcaaggagagcccacagggagaacaaagagagtgtcctgtgaaagctatctcttgaccctgatggagagaagggcgctccagcctgtgcagatgtctgtttccggtgccatcgagctctaacttcaaccttgactctgctttccgagtttgggtaagacttgtttcctactctatttgaggtcatcggagaccatcactttatcatggatgggaaaagttttcaggtgatgaagggctgtgctgttgatttggaaagaggacacaagactggacacttcctttcagggtaccatttctaggccctcttgatattttaatatgttttaaaaattaagagaatgtctgcatatgtactagaggaagtcctgttacacaggaaatactctaaattcaactcacatgcagttggttcccattttcaattcttgggaatatgttagaaaacaaaaattttaaccttggagttaaaatctgttgctattttcttttctttttctttttggagacagggtctatgtcactaggctggagtgcagtggcatgatcatggctcacctcctgggatcaagcaattctcccacctcagctccccaagtagctgggactacaggtgtgcgccaccacactggctaattttttgtattttgttgtcgagacggagtttcaccatgttgcccaggctgatcttgaactcttggaatcaggcaatccacctgtctcagcctccgcaagtgctgggattacaggcatgagctaccttgcctggcctgctattttcacagatgctaaatgaaaacactcagaattctatgaaatcattcagactataaaatattctttagcaattcaagctgctgtttatgaggtgggctgtttatagtagggtagatgcttctaatctaatgtagaattgcagctgcagcatagaaagggaagaagaattgagagtacaccaagatgttaaatgtttgtcttttggttgtggaatatgggtgagctcccccctcacttctttatacttttatataatatagaactcttggttcttctgtagtgaatatttatttttaagaaagcagataaatgttgcacataacttgctttggaaaacttttcccattacggttacttgaagactgaaagatttttgttgttgttgtttttgttttttgagagggagtcttgctgtcatcacccaggctgggagtgcaatggcgcgatcttggctcactgcaacctccacgtcctgggttcaagcaattctcctgcctcagcctcccaagtaactgggattacaggcatccgtcaccacgcctggttaatttttgtatgtttggtagagatggggtttcactgttttggccaggctagtctcaaactcctgacctcaggtgatccttccgcctcggcctcccaaagtgctgggattataggcattagccactgtgcctggccattttttttttctatttttaaaatccttcatatcttccatggcagtaaatatggtaaaataatatgtatgtgaggatttttataatgcataaaatattgtagaagataagttcttgtacatgcttttgaatcgtttcatttgccttctctctttggcttacataataaataatgaaaactgcagtttctgacttgggccatctaacattcctaggaagggaaggaggaggcaggagggagacactggaagaggtggtagaatcacagtagcttttgtttttgctgcatgccagacacaaaatgcgaactcacattatccaggctgatgagtcctgcaggtcagaccccacagcataggcaggcagttatagttggaggccttccctcattgctaagggagttccttagcagaccaattcggaatgagttatgtgtaaaaatgagcacagaatgcttaatgcagtgggccacagaatcacatctgatgttcaaacattctaatgaggctaggtgtgatggctcatgcctggaatcccagcactttgggaggccgaggtgggaggattgcttgaacccaggagttcaagaccagcctgggcaacatagggaaactgtctctccagaaaaatttaaaaagaagcaaacaaaaaaataattagctaggtgtggtagtacatgcctgtagtcccagctactgggaggctgaggtgggaggatcacttgagcctgggagttccaggctgtagtgaactatgatggcgccaccacactccagcctgggtgacagagtgagactttgtttctaaaataaaaacatcctaatgatgtgtggtgatgctgtgttgtatactgtctgcatgctatagtcatttggtaacctaattaagattttaggttgtaaatttttcatttataacttcctgagattcatttcttttaatactcgttaaggcaacataaatttagagtttggatcattttcctcttaacttgttgttttacttcacgattgctgcatttagaaaacttttaaaattttatttaaaaaaatagataatcccaaggtgttgatattacaggtgtgagccactgtgtctggccagattcatttcacttaaatccctgaagatccacatgggattctgacagatcgctctgagacatcctcctgttgtttccttttcaccactgcaggtctccacctgccctggtgtccttgggaggaaacccaccgtggtagggcacacagcggctgacttgtcctggtaaatcataagcatggtgggctccgcaggtgcctccctcctttctgtccttgagtctgaagccagcaccttctttgatgacacaaacgtctgtggtttagggttttcaaaggaattccccctcttcctctcccaccacaagaaaggctgctgtggggagccggtagcttgcaggctgggttgtctggtcgtttgaattccacaagaaagccaacctagctgtcctggcttggggcgaggcgggagggcaggagtcctggatctgcctgtgtctgtctgtccctggctgtctgcccctccctcctccttccctcccctcttgcttggggttgggtggggtctgtcttagggagagaaggagggcagggagggagagagctggaatttgaccccagagctgtctgcagcttcccaggagcccttttcagaccctgtctggctccttagaaaggctgtgtggctcctgcgtggcagggccacctcattaaaaacaccggctcaggggagggtgctggtcactcttggggccaaccaggatgtttgcatttgtcctatgcacacagtacaaagttgttgttttttaaataccattttagaggagttttagctctacagagaaatgcagagatagtaaggagaattctcacctcccccacactgggcttccccctattgttttttttttttcttccaattaccatatatccctgccatcccctattgttaacatctcacatcaccatggtatatttgtccaagcaatgaaccaatattgctacattatttgttgttaactaaagcccaaactttgttcctatttccttagtttcccagtttcccattaatgtccttttctgtcctgggattaaccacatgacttttttttttttttaactgagacaaggcctctctctgtttcccacgctggagtgcagtggcgtgatcatagctcactgtggcctctgccttccgggttctagggatcctccagcctcagcctcctgagcagctgggattacaggtctgcaccactacgcccagctaattgttttgtgtttttagtggagttggggtttaaccatgttggccaggctggtctcgaactcctgacctcaagtgatccacctgcgtcagcctcccaaagtgctgggattacaggcgtgagccactgcgcccggcccacatgacatttagtcttcctgtcaccttaggttcttcttgactgtgacagtttttcagaccttccttgttattgatgactctgacctttttgaggagtactggtcaggaattttgtagactgtacccctcttgggattcatctgatgattttctcatggtagaatgaggttatggctttttgcaaagaagaccacagaccattctcattacacacgatatgttttgttttttagttttgattttctaacttttcttaactgtaggaattaatgaagatttttccacaattcctatgctttggaaaatttcctttgatgatgaaatttctttagggaaaaaattatttttcttctgaaagtgtttaggcagagaaactttgttactgaaatattagtgatcagagctgctaagttatagcaaatttgtagagataattgtcccagacaggagggtctgctgagtatgtcctgtggatatgttatttatcttattctgtgctgttgtgcaccctaaaaataaatattttaggctgggcatggtggctcatgcctgtaatcccaacacattgagaggccaaagctggaggatctcttgagccctggaattcaagaccagcccaggcaacatagtgagacggcatctctccaagaaatttaaaaattagccaggcatggtggtgtgcatctgtgatcccctgcttgggaggctgaggcaggaggatcacttgagagcttgggaggtcggggctgcagtgagccatgatcacaccactgcactccagcctggtccacagagcaagaccctgtctcaaaaaaataaaaaaattaaggccggatgcagtggctcatgcctgtaatcccagcactttgggaggccaaggtgggcagatcacctgaggtcaggagttcgagaccagcctggacaacatgataaaaccctgtctctactaaaattataaaaaaattagctgggtgtggtggcgggtacctgtaatcccagctattcgggaggctgaggaaggagaatggcttgaacccgggaggcaaaggttgcagcaagctgagatcgtgccattgcactccagcctgggcaacaagagcgaaactccatcttaaaataaataaataaattaattaattaatttaaaaaatggtagatttcaaaatagtgtttgaaagttcttggcgaattggtgtgctcctgcgttcctctcaactcccactcttgctcagttgcctaccatcacctccaatctcctgatgctggatttgcaagttaaagtatttctctagcgtgggagttggcaagtgtcttctgttaggagcccgtaaatgttttctgtttgggccacttgttctctgtgggactcctcagggttgttgcagtagcaggaagcagccacagccagtgtatacatgaaggtcgtggctgtgttccactaaacctttattcaccaagcaggtggcaggccaggtttggcccaaaggctgtagttggccgacccttactttattgcagaagtgtatactgccaggacttttttcttgtttttgttttgctttgttagggagtctggctcatttggcccatgtttatggggcactgactctgttgtttagcaagcgctgtgttgctaaagaatgttttcgagagatttagacccacccagtaaacctgaacaagaagccagcctgagcagttagccggggtcacagttctccataacttctccccctgcttcctgctggaacagctcacttttgaaatggcaggggagtcattccaagctagcatctcccatcccaccttgtcacccacccccacccacctttttgttttttctggaaaacaaataaaggcttttattgtatctacttgggcaggatgaggggagtggtagttccagagacaaaggactcagagccaggacctggccctcacctctgcgcacaccagcccacactggctcccgtcaccctcctttctgtccgtctctgctcctctctggtctcaccccgtctgctgcagacagtccctcttcatgagttgagaaacataattcctggcagctgcagtgtcgcaaccccttcctctacattttgtggaatgaacacagctatgtaactcgctacccagatcaagagatggaacattcctatttatgttttaggaatgttctagctccccaggggtgcccttgagcctccccaaccccccaaatataggactgtcttgaatgtccacactatagatgaggttagcctctatttggcctttatataaatagcatcatctagtatggactcttttgtgtctagctttttcagtcaacattacttttgtgagattcattcatattgtttctggtggcagttgtagtttattcatttttgttgctgtgaacctcagtttgtttggttttggttttggtttttgagacaggatctcactctgttgcccaggctggagtacagtggtgccatcagggctcaccgtagcctcaaactcctgggctcaagccatcctcctgcctcagcctcctgagtagctgggaccacaggtgcatgccaccacgcacagctaattcttttatttattattattatttttgagacggagtctcgctctgtcacccaggctggagtgcagtggtgcaatctcagctcactgcaacctccgcctcccgggttcaagtgattctgctgcctcagcctcctgagtagctgggactacaggcacgtgccaccacacccagataatttttttgtatttttagtagagacggcgtttcaccgtgttagccaggatggtctcaatctcctgacctcgtgatccgcctgcctcagcctctcaaactgctgggattacaggcatgagccatcacacccggccaattattttatcttttatagacatggggtcttgatatgttgcccaggccgctctcgaactcctgacctcaggcatgagccactgcctccagtctgtgtgtttttctaaagaattcttagtggctaaggaaggttaagaccttcctatcgtctctttcatctttccccagagatgagccattttgaacatggatttggcatctgtgccgcctctgagcccatgcttggctgatctgtggttggcgtctgccttccagagaattccttgttttcccacagtccctttgcagctgtttcatggagcacggggacgcatgctggctgctgccaccagctctgatggctatgaaggtttgagacgagtctcataggtgaaatctgggctctaagacagcccaccttttgaaaggacaattcagccaccagaatatcatcttcgatctgctggttttctcattttggtttccaaaagcctttagccattgttattattccgtgcttgtcttggtgttagctcagtatccatgaaacccgacaaacctctttctagaatgaggccggcaaaccagtctcataatgttcaaccccagtgaagaggaactaaacctcaaaattgttgtaccacaaactctattggccttttattggtggggattttgtttttattacaagaggggtgactgctacagtggcctttccggcaccaggccgtgcctgacggatgagaatgctgtgtcataaacagtcttttgcaatgactaaccgtgctgggttggaatgcagtgcacaccaaaggaaggtaggacttttagtggttgtcacaatagctgtgcgaatccaaatatggctggaaaatgtcaacatactctccagattatcagctccgacgaatgtaagagacatagtgttagggggatgtctggataagttgaactctaatcagagggaaaagggggttggaggaataatgaatgagggaaacacttttattgggagaatagcttgcaaaacggccagttgcataaagtgtcctgtcctaagaagtcctagtgtaagcctcggccagtcctaaaatatgaatgagacctaggacttattttacgtattgctgttatccttactagcacttttggagtctgcattctggtaatgcctaaatgcttgtgctgagttacatgtggaaacagctctacacaacattccctagtctcttggacacttacagtgttggccagtccttttctcgtgattttttccctctgatttactcgtgttgtaacaaagttatcacttttttattgtttctctttgctttcatcctttgcatctgtggctgctcacttgctatgcccagggaaggggaagatggagaaatagattatggatatggcactccagggcctgtttaccaacaacctgaaaagcttatattctcagcaggtcaatactccccatgtctgagggcgaatgttgtgtggattaacaggcaaaacatgttgcatagatttgcagatccacgtttacagattccccactgtatactgaggccatcgaggaacctgaatttgtgtatcccttgtggctattgatatgttgctgaagtcaagtcaggtatgtattgaaaagcatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgactgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaaaagcatgttctaagtatctaagtatttaagttctacatgtctagagataaaactctctttatacggggatgtgaggagaggaactaggaggagactttatcatgtgctgatttatgctctgccggtaatgagccatgcagccctaagcatgttacctcatatctctgggacgaataaagtgtctgtcctttggccaattttttagcttcccgaatcagtttatcgacaagatggggacatgcaggtgtatctgccagggttaggggaagctctcaatagtaacgtgtgctgagaaccagctggtgccctgcgtgagtgcagcgctccgtgaagaacattgtgttatgaactcctgggatgcctggattcccttccattcatccactttgttcacctaaagggccagagcaaacaaccgtccactcaggtaaacattcccaccccagagcgaccgtttgcatcctccaggagttaacagtacagctggactcacccgtgggtctcctggaaggcactgtgtcggaaaccgagcttctctcctgcttcccttgctgtggcctatctgggaatctatagtctggagcatcccagggcggcctcctttggcagatggtgtaggagtgctgcaagccctcctggatgcacccaaggacccaggaagatgggagcgtggatctctgtgcctcagcacagaggctgggaggagagacagcaggcgccggctggcaggagcagtccatgtgggagcttctgtgtactcccacctctgcttcacctcctgttgatctctcctccctctgcagcacattctgccctccttccccagactcctccccacagttcgccctgaaacaaacctttccatgggattgattttagaggctgcccatgtgggaccagggctgcagcttccctatgggggtgctggtggccttgtggcacttgctaagctgggcgggcgtggctaggagtttgagcagtaaccaaagtttcctctctgctgagtgctcctggggtccatccctctggggtgatggcaggcagctttacacgtcgccttagagcatgtctttatttgctcctggatcaagaaccttttgccatcaatgtagggctgagcacccccaccaccacacatgccctgtccagatatctcgctctggggtagaaggaggcagttgtgggaagaagtttcctcatcacattagctctaggtaatttcagagaactttgccaatctcttccctagcttgtaggtacaatgaagataacaccagcagacaagataggatactctttcttgagtttaaaaggcatcaaaatagttgcatgcaatttagcaaggaatggatacattagattgtatttaagagagtgcctgttgctgtacagtttttaacaacacgttgaagcagagcaggtacctctcagatactgttttggtggggaggattggggacagtggtttcctgctgtcacactggggagaactgaaggagagaacactgctgcacctgagcggagactgacacttttgaggtgagcaccctgaaccttgggtgtgtattgtccctctcatacctgctgggcatcttggggccaggctgggctgcgtggcagctctgtgggatcattcccgtctgcagcacccgggggcgctgctcattgtgtagaccaaaggccagccagcggagatgcccacttgctgaccttcttacatgcctgcttttctgctacaagctgtcattttcttttattgattggttggctgtcattttcttttattgattaattggttggttggttgacaggccacatcactgcagctttggtatagtcacttctctaatctttccaaaaagtcgcttcaggttatgaagtgagttagcggcctgctccctggttgctccatgagagttcgccctctcctcacagttgtacagcgggccagcattgttgtttggcttcctggctcatatgccccttctctgtggcaccccatgtccttatgaaaatgacctaagccaggcgtggtggtgcacgcctgtaatcccagcactttgggaggccaaggcgagtggatctcttgagctcagggagttcgtgaccaccctgggcaacatagtgagatctcgtctctgcaaaaaatacaaaaattagccaggtgcggtggcacacagctgtagtcctagctactcaggaggctgaggtggggggatcacttgagcccaggaggtcagtgagccgagatcgtgccactgcactccagcctgggctagcggataagactctgtgtcaaaaaaaaaaaaaaaagagaaaacaaacagaaaaacttgtaccctggtattgataagtcttaatgggagggcccctgcctctcaccacagccttccggaagtcagccagatccctttgtttccagcccctggtagaccagcgtggccttatgatcccctctttgtcagtctcatctcttcctctctctttttttagagacagagtctcactctgtcacccagactggagtgcagtggcagaaacacagctcactgcagcctccacctcctgggcacaagtggtcctcccacctcagccttctgtgtagctgggactgcaggcacactccaccaagcctggctaacgcttttaatttttgtagagatcaggtcttgctatgtggcccaggctggtcttgaactcatggcgtcaagcagtcctcctgccttggcttctctaagtattgggattataggtgtgagccaccatgcctggcctctttttttattttgagatcattatagcttcaggtggcaatacagagagatgccatgggtcctgtacccaggttccccacgtggcaacagtaccttttttgtaatatgatggtaacaatgtttcaaccaggatattgcttttttttttttcttttttttttggatagagtctcattctgtcatctaggctggagtgcaatggcgtgatcacggctgactgcagcctcaacctcagcctcctgggcccaagcaatcctcctacctcagcctcctgtgtagctgggaccacaggtgtgcgccaccacacctgacaaatttttgtatttttttttttttttgtagagatggggtgttgctgtgttgcccaggctggtctcaaattcctggtctccagtggtccttctgccttggcctcccaaactgctgggattttacaggtgtgatattgacatagagaccgtcaagacacaagacatttccatcccaagaggttccctcacattgccccttttaacttctctcttgctataaagatatcaagttcaaaactttattatatagtaaaactctgttaatcaattgttgaccgtttaaactggaatttaactgagagccaaggatcttccccaggtgactgaagtctgatgtatcccttcaacttctagttttgaattaacaggagttcagtgtatttggagagaggcctgtcactcccttgttctgttcctttaaagagttatggtccagtagagagggcacgctcgttaaaagcagtctctcgtgaagtggatcaagatgtgttggaatgtaaggcatgactgctagctgctgagcaattcacatactttggaggaggttagtgcccatgaaaaggtagatgcggtaatcagaaaaaactccaggctacctccgggcaacatatttggctaatgctttgattaattgaaacatttaattaactagattttttccccatgctttgcttttaggaaggatccttcactttctgccttggcaggggagtggggaccaaagatattaccctctgattcccagaccacctgcaggcgttttccagctgggattagtctagctccttgctggcttttcatggcacctgaagcttagttcttattgccatcaccttgaaggtctgctccgagctgggtctaccaaaggctttctctttctgttatgcctggtctccagtggtccttctgccttggcctcccaaagtgctgggattttacaggtgtgatattgacatagagaccgtcaagacgcaagacatttccatcccaagaggttccctcacatcgcccactttccccctgggatacccagtgcaccttattggtgcaaaaatttgtatgaattgcaattttaaagacagtcgaatttgacctgcaataaaaatgatgattgtaatttgtcatggcagaattgtaaagctagaaaagatctttaggattgaactgatcattttatggataaggaaactgaggcccagaaaaggtcattggtttgcttctaatgtgtgtttctatctctggggagagctggaaacataccctctttagccagtggtgcccagcccactcaagttgttaacaatggatggatgtagacctactatgtgcctcactctgcattctccggtatgcagtggaaccaatctagaaaagccggcatctttacagccttgagagtgtgcttctcagtgggattgtggatggtttcctctttaataggaaagcctgtttttatatagatgtatttcttgggtgctgacagacccagcaccaccagctcctaagcgagccccagtgttttctgctggggacaggatccagaagcatcccgtggaggggttgggtaccccagatccacctgccaggactccgggagaggcgtgtgtgagcagccagtgagcccccagctgtggaggactgaggcttcctgatctccttctggaacattcagtggccacaccagcagttctttgtgctcacttactagcccatttcttgtagcaaatggaggctacatctgtttcgtagggctgtcataacaaagtacctagcacaaagcttaaagcaacaggaatgtgttgtctcatagtaaagaggcctggaggccagaagtctgcaatcagggtgtctgcagagcctctttctgaaggctctgggggaagagccttccttgtttttcctgcttctgtgactccaggcattccctgacttgcagatgcatcatgccaatctctgcttccgtctccacatagttctcccctgtttatctgtgtccaaatttccctcatctgttgtggacaccgttattggattagggccctccctaattcaggatgacatcgtcatcaccagttacacctccaatgatcctatttccaaataaggccacatgtacaggttccagaggtgaggcttcaacatatctttttgggagacataattcagccccataacaaagggtaataaaatgttttgagagagaatctaggtacagaaaagtgctcacatggtagcatagacattgatgaattttcacacagcaaatcatacttgtgaccccacccagatgaaggaatagaagagacagtcttagaaaatagataccaaattccatgccttatggagaaagccaaggctcgttagtctggtttgtgcttttagggttaaatcaggtacgttgttgacacttcagaccaggtacacgtagggatgtgggtattatgctgcaaatcacaaaggacagtttcactttttaaccccagtggcttcctgagaactctattgtaaagcgtactgttataaactaaattgcattttgaataggaataattagatttaagttagagattctgccaaaaattgctttatcagatcggacgtgagcagttacatcataaaaagaagaaatgccactcaaacctgtgattgccagtttaggagaggctttgcctcttgggccattgcttcatgttcccattttgggtgccttgtctataaaggggaggaaggggtgtcgggatggctctctgggttggatagcgggaggagactgcagcccacatctggttccagcctcttgtcacacagttgagggagtggagcccagctgagattgacctgctgaaggcacctggatgggggtcatagttgccatccctttattttgcattttctcgtgttttaaagctttggtgcccaccgattccagccctgctgttcttgtgaaagtcgcatacacagagtgactgtcacagcaactcattactcttcacggtcctgagtttgcttttctgtaaaattgagaaagaaataattgcctgacctctcatcccacgattgtttttaagagtgggaatcacagcttggggggcagggagttgagagcttctgctgtagtggtgtgagcaacacaggatggccatatttaaattgggattgtactgtggagagttatattaaattcataaggtcaggagaaacagaaacacgggagttgggccttattgcagactcctcctcggtgattttatttggagtaaacggcacacgtaatcttagcatgtctcatgtcaaaatcacttcaaagaatgccacgggtgagtctgcggcagatgttcagggcatctttttaaaggagaaccaaaaaattaaaatttatttcctttttaattgtggctgttttaaactttgttactttaaaaattacatatgtgtaagtggtccactctttttaaaaaaaaaaaaaaaggcatcctcattgttcaactcctggacacagggagggaaacatcacacaccagggcctgtcggggagttgggggtagagggataacattaggagaaatacctaatgtaggtgacgggttgatgggtgcagcaaagcaccatggcacgtgtatacctatgtaacaaacctgcacgttctgcacatgtatcccagaacttaaagtatagtaaaaaaaaaaaaaaaaaaaaaaaaaaggcatcctatcatatcttggcaccctcgatgtcaaaatgtggtaaaaaggacctttgcccattgtgttatgcattttagctctgttcagaatctgtcactgttacctacgcttattttgtttttagaatttgggggcagaaattttttttatctgtcatggaaaatagctgatgccccaatttttgaactcgataaaaatcccaactattcccatattaatccagatagatagatagatagatagatattgcatcagattttgtccctaaaaggactgagtacagtacaggatgtggagtgaaacaaggctgctacggtttcagaaacagctttggagctgagactttgccaaggaaagtgggaactgctctgcgccaggaagaagcgatgaacccatccttgacttgtacgaccatcgggtgtgtcagccgccttgtcgctgtgctctgcaaactcttgcccaccacgaactaggcacacgcttaactcagtgttgtggcagatggatgactaattcgggttttaacttggaaaagcagaggtgggcagattccaccatcctggcagaaggttgcatacccgccaaagcgcactaaaaatcttcctaagttactcggctttagctgaggctgagtgctgctgtctcagaagaattaattactttgaatgggagtcattttttaaagacttaagaatgtttccttttttttttttttttttttaaagcaaaaccgaatgaacttgggggaaataaatgctttgcctttgagagttgtctgctggaaaaagtcaacaaagggcttctgggttttgttcagtggtgtcttgattagagtggcataaatcttaagtactttcagaggaggcttacaaattagagaatagtttggctgttttggtttgattctaacaagagttcagcatggagaaataataccactgatgagatgaggaatgtgtttagcataataaaaaaactacctccgtgtagccccatttttcgggcagatgcaatttgtgtcttaaagaaaaacataaaaacagccagacattatcatttttctttgcttgttcctcagacgcattaatagattatacccctcaatctattgggattgagatgttttatattttaattacacaagtgaacaaagttttgctgtttagaactattctgttgagtgttggtttttaagttataaacattaaaggaaaaatcatctggacttatataatgatgagtcttgagaaatgtcagtgttttctgggaagagttgttccattcttctaactgcctcactggggatcctggactggagcgtttgcccctgggatgcagcgccggggcacccctacttctgggcaagaggctgtgctgttcctggcctccgtgactcttcaggcctttctctcccagttgcatggtagctgctgcatccccacgcatcctgtctttgtttaagaccagaagaaaagggaaagggtggtaccagacatttctgcccctttgattgcagagacaaaggctctcctcaagcctgcagctgacttctgcctttcccccatccgctgggaccgcacatgccaccctgcgctgcaagggggcacgaggctgctccagtctccatggtggattcagatattaaggagggcagggctgatggctgccagggatcctctgatattagtaatgggggagagaggaggacgtcagttccaaaaggtgcggtcttcctggagaacgtgggacttgaatgaagccctgatagagaagtcaaatttgaagaggcagaaagaggacacgaaggtgacatgctaatgaagtctaggatgaagagaaacagtgagggaacgttgagaacaccaccttggtgtgtagggatcctgcatgacactgtggattctaacacaaaaataatgcggaaggaattgatgtttatacagagtggggtgtgagtttcctgcaccagagcatgccagttggtggttacacgtttgacccttggacatgattttagggggagtggggatggcctcacctagttttattttttaattaagaatttttttttttttcagagacatggaatcttgctctgtcgccctggctggagtgcagagtggtgcagtcacggctcactacatcctcaaactcctggtcttaagtgatcctcctgcctcagcctccagagtagctggaactacaggcacacaccaccacaccctgctaatgtttaaaatttttttgtagagatagggcctcaccatgttgcccaggctggtctcgaactcctggcctcaagtgatcctcctgccttggcctcccaaagtgctgggattataggtgtgagtcactgtgtccaccgtgctttcacttagttttaaaagcaaaaagattgtgaacatttgcagacacagggagattacccaccccgcccccgaaattccagattttcagctgcattaaacacattgcaaaattcgtgcatcctggctgctcatttccccatgagcagtcactacccccgacactgggtagtggctgctccttcagaaggaaggaccctgtcccttcaccacaatgcccagtgctcgaggctgtagaccccatcctgagggtgtgtgttctatacatgcagcccctccacttgcagcggcccctcccagcctctgcgagcgctggcgtgtgcactccagggctttatgttttccccgtgttgccttcttaggctctgctgcctaggctgtgacaaaggcatccctgaagagagttgttcaaaaaagaaagatagcccttgtgacgggtgagatcatccatatgttacccaataaaaagtcaaaggcttgaggggccctttgagttcactccagagaaaggtgcagcagcctcggctcagtgccccctaggcctccctgacgttgcacggcggcagcattagattatctcactgaacaaggcccgtccctttgaaatagcagtaggatgggaatgtccattaaagtaaacagctgtgcgttctgagaagcggggacactttgttctaatggccagcagttccttttcctgtttcttggttgcctatcagttctttcagatcgccttttcactttgaaaatgcaaaattaagtaatcccagttatctctgtttaagcgggtgcttcagtgatgtgatgacttgctttcaaaagctcagtgaggccgcgcacggtggctcatgcctgtaatcccagcactttgggaggccaaggcaggtggatcacctgaggtcaagagttcgagaccagcttggccaacatggtgaaaccccgtgtctactaaaaatacaaaaacaattagccgggtgtggtggtgggcacctgtagtcccagctacttgggaggctgaggcagaaaaatcgcttgaacccaggaggcggaggttgcagtgagctgagaccgcgccactgcactccagcctgggtgacaagagcaatactctgtctcaaaaacagataaaaaagctgagtgagaaggggtgaggatctgggcaggtctgcgttctgtgttggctggaagcctgctggcggtgctttgactaaacaattcttgatacttctaagatggacttgaggccgggcgcggtggctcatgcctataatcccagcattttggcaggctgaggtgggtggatcacctgaggtcgggagttcaagaccagcctggccaacatggtgaaaccttgtctctactgaaaatacaaagattagctgggcgtggtggcaagcatctgtaatctcagctactcgggaggctgaggcagggagaattgcttgaacctgggaggtggaggttgcagtgagctgagattgcgccactgtactccagcctgagcaacagagcgagactccattgatggacttgaaagaccaggaatatggtacaggttttgttttttcctcctgtagtgctaagatgaaagcagggctttagacaacgtcgcttatgttcgatgattctttttctctctgttcatcctctccagaaacattgcctattgcattgcgaccagcttttgtataggaagggaagaaacagatatcatttgggttttgtcatcagtgagatgctagtcttgttgtgggatgagaagcataagctggtaactgtcagcagggttaggagcagatagtggccatgtgctccaggcactagggaggctgggagatgtacagagtcccttggtggagacggtggggttcaagatggcgtcctgagggctgaatgtgggcgagctgggcagagtgtgtgcacagcagcgatgggggtgcatggtgtttccagaggggacccagtaaacaaagctctgcaggcaagaaagaccactttctctagggaggaaggacaaagggcctgttgttgcgggtgtgtgatgtttgggcagggtggggatggtgtccagaacagcaaggcttgttttacatggtggtgagtaggacttgattaaatgcagtgcctccctccctccccctcacctgatcaaactgctcttttgcgttgctgctagaggcgagagagaagatgatttgcgtgaggaagacggctgcctgtttcctgccgtggtaaatggattttacagggcaggaggttaaagcgtgactttagaggtgccttggttttgttttactgttccacatgagccatgggtgaccatttctaatacgttatcctttctctggaatattggtggttctcccctgggggcagttttgtcctccaggagacatgtggtaacatctggaagcatttgaattggtcacaactcggggcaggagggtgctactggcttctagtgggtagaggccagggatgctgctgagtcccctgcaatacccagggcagccctcacggcaaagaatgatccggccccaaatgtcaatagtgctgaggtggaggagcgtggtttggagtgtcctattgtttatccatgttttatctattggacatttgggtaaaataacccatttgtagctcttacagatggtcctggtatgcacattcttctgtgggtcttgtggttaacatacatgcacatcactgagtcacttggtctgttttcccagtcatgtcaatatttttttttgagacagggtctcactctgtcacccaggctgcagtgcagtggcgtgattttggctcactgcaacctccacctcctgggttcaagcgattctcttgccttagcctcctgagtagctgggattataggcatgtgccaccatgcctggctaatttttgtatttttagtagagatggggtttcaccatgttgcccaagctggtcttgaactcctgacctcaagtgatccgcccaccttggcctcccaaagtgctgggattacagacatgagccaccgtgtctggccactcatatcaattttggtattcaccccgtattcaggagttgaaggtgtaggaagcagcgcaaatggacattgacagacgagtggataaagagaatggagagtgtacatacagtggaatattgctcagcctcaaaatggaaggaaatcctgttacctgtaaccacatggatgaaccttgagtccatgatgttagctgaaataagccagtcctacaagggcagatactgtatgattctacctatgtgacatatctggaatagtcaagttcacagaggcaggaataaaatgcaggttgccagaggcaatgggggattgttcattgggtactgttgtggttttgcaagttctagagatctcttacacaacaatgcgattatagttaatgctactgaactccatgcaattaaaatggttaagagaacacatttgatattatgtttttgttgatgctgttgttgttagagatagggtctctctctgtcccccaggctggagtgcagttgtacgattataactcacggtagccttgaactcctgggctgaagtggtcctcctgcctcagcctcccaggtagctgagattacaggcatgtgccactgtgcctgactaactttaaaaacaaaatcatagaaacttggtttcattgtgttgcccgggctggtctcaaaactcctagtctcaagtgatcctcctccattggcctcccaaagcactgggattacagatgtgagccaccatgcccggcatatataatgtgttttttaataccacttaagctctgatttcctcgtgttatgatgaaaacggatactttgtcactgtccctgagagtggagcagcatagcctaggttccactggcagtttggacatgaagaaattataacaacagcagaataagttgtaactgtacttgtagcatactttagagtttgcaacatattttcataattgtttcactgttatcctcctggtcgtcctaggatgtaagacaaccagctcttaccaccatttttggggtgataaaaccaagagtaggaagcatttctccaaattgtgtacgtaagtggcagaggcaggtcttcagtaccagatcattcctcatcttttgaaacgctccgtgcccccaccctctgatgtgattattccctcctgtctgccaccaggggatcctgtgcatgtctgtcactgcacttgcctcatgggatttgtatcagccaggatctagttaggagacggaagccacacagtagttggaacaggagtgcttcataggaagcgggatttcgtggactgaccaaatcccaccatgcccccgtgcttacggcttttctgtttacagaagcaaggttgaacagttgcacagagatcgtgtacatgcaaagctcaaaatatttacattacggctctttgtgaaaaagtttgctcacccctaatgtaaagaactattaacttgtggcagtttattatctattatcgacgaattattaactagtagctactataggtaaggagaactctaaagaatacgagaatagcagatagagggagtggccactccctccagggctggggcacagagtacctgaggaaggaataaatttggaactattctccccaccccctccaaagctgagattcgaatctcgatggaagatggctcactaggtagtggagaaagtcgctgagggccaccgctggctggagagtagggagccacccccggcatgccactgaagctcactaggaagctggctgggggtgtctgtgggactcggtggaaagccaccgaggaattgtctctaaaagtcgctgggaagctgcccgccagagcaccagtggaacttgctaggaggccgcccttggagcttagtgccactgtgtgtgccacatgactgccaggtcccactggagcaggcagggaggaaagcacgctggaatgatgaaggcaagccctttccaccgcccgcgtgcctccaccgccctctgctgatggtgctcaccaggtgccagcactggagaaacgcccacagggtcctgctccaggatcaccatgtgggcagtgaaggtgcatttgggatgcagaggcaatgcattgctaactggcaatgttgcaacaggttgtcttcagagctgcactgtaaattcctctgacacacgatggtgttccagaaatcctccctgaacgttgctccccattaaccatctcttaggtggatctcggcctgtgctctgtgaaattcagggctgacatggtggtcaggatttggccaagtcctgaggccccaggatctttgctacatgtggagaggaggcacacacctttgggctctatgctgacctccctccaagaagactgtcaccccttgccacagaatgcacactcttcttccggtcccgtccagttggcctgcattctgacgctgcagctctcacctgcccagggcacattccacccctgcccgtttctcccagtcactcctgggacagtcagcttgccttccgttgctctgtagaaatgctgtctgccaactcagtctccaccacctccagatcttcacctcatctccctccacatttttgggagccacatgcccccttttcacctagccgatcacccagccgtaggttttctgtcatgacactcccttggcctgtgtgtccattagcatggctttgtcacctggtgcagccacgtcctcgtcctctcctcatgcctcatcctcgcgcctctccttgccatggtgcctcgtgtggtgcagccctcattttagggagagatgaaacaagggctagacctttgtggactgaatacctccttgagcatctagttccaaaacacacgaggagggttttggtttattttgttagtgttatttattatttttttttggggggggtgtatatttcttaagagatgggtgtctcactatgttacccagacaggagtgcagtagctcttcagaagcgtgggcatagcacactgcagcctccaactcctaggctcaggtgatcccgccatagcctcctgaggagcttttttgtattgtattatcatttttcttgctttcttactaattttgtcaactatgaggaaaggaattttttctttcctaatagagattttattgatactttggaagatcaatacaaagctgtttcaatgtgtatcctgttgttaatgtccttacagaaaatctaaagagctgtgtcattggattcttttccaggtactccagcgaccttctagctgaaaacttggaggcaaattttccttaaaaggccaggaattaggattttttgaagtctcagcacctttgggtggtggtttccatctttaggagcacgagtctgtctccgggcgaaacttcagtgtagatgcatgttctcaggatatttcacaacttgctgccttgctggatgggtcacatttccttccccaagcgccggtaccttcagatgttgacgagctgtcacatcagaagtcacagtcactcaccgttatcagcaacactgcatactcaagttttcagcctttcatagcacattaacagagagattaggaaaaccgactgccacgaccagaagactttcagggtgcatgcctctctgatagggagagccaggatcaaggagtccttttccttccgaaacagttctactaaaaaacaacccatgggctcacacctataataccaacactttgggagaccaaagcaggaggtcaaggtagtaggattgcttgaggcctggagattgagaccagcctgagcaacatgctgagacctcgtctctacaaaaaataaaaataaataggccgggcgcggtggctcacgcctgtaatcccagcactttgggaggccgaggcgggcagatcacgaggtcaggagatcgagaccatcccggctaaaaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaataaataaataaataaaaataaataaataaaaaattagccaggtgtggtgacacatgcctgtagtcccaccttcttgggaggctgaggcaggaggatcgcttgagcctgggagttcgaggctgcagtgagctgtgatcgcaccactgcactccagcctgtgcaacagagcgagacccagtctcaaaaacaaaaagcaaacctatgagtataagtaatttaagctgctcaagacatattaaaggcctgaccatgactgcaaattgccagtcagtatgctttgtgctgtaggatatgaaaactgtccacccagcctagcacccaagacagtcaaagcctctcataaaatatataccaaaaaacaactagcaaatgatttcacctcttttaaaaaaagcatttatgcttaaaacatggaattaggtgggattctctccttaaaaatgtttacagaactactaaaaaacttgcatttacaaaacagttgctgaaagtattcccctggcatatatgggaagggagacaggggctgctgagcagtgtatgatagtaatcaggtttctttccctcctgcttcctgggagcctggactctacttgcatttagactccgcttcctgcaggtcaatcttcaggttcctgctgagccacttcagcccatttgccctttgctcccccttttctcttttgtgctttttttccctaaggatttatcctttcctgctgccttttttttttttttttttttttttgagttggagtctcgctgtgttgcccaggctggagtgcagtggctccatctcgactcactgcaagctctgcctcccaggttcacactattctcctgcctcagcctcccgagtagctgggactacaggtgcccgccaccacacctggataattttttgtatttttagtagagacggggtttcaccatgttagccaggatggtctcgatctcctgacctcatgattcgcccacctcaccctcccaaagtgctgagattacaagcgtgagccaccgcgcctggcctcctgctgcctttttgggcttcatttccacttctgcagaagcaggttgagccgacagcctggcggacctctgggctgtgccttggccacccctggggctgacctgaccttccccttgggcatcttggcggtgcctggtgcctgctgcccaaaagccttatgaatctggatgcaccgcaactcccttccctgccctggcctctgggaccacagcaggggccaggaattttttttttttttttttttttttaagtctcaacacatttgggtggggatttccatcttctaggggcttccctgttatcggagcacaagtctgtctcacagagaaccttcagtgtggacaaggtgttctcatttatttcccaacgtgtctctttcctggatgagtcaggtttcctttctgaagacgccgagctcaataaattaagcagactgagaggtgacttcagtgcttgtcctcatcatgcagatattttatctctggaaagcgaagcattgttgaggtggtcagaattgatcaattgcaggtgtgactcatagcccttgaaatatgatattggacttaaaaaaaaactgctttctctcctctcattttgatttctggtcactgtgattttccaaatccctcaagctgaaaaccctgcggcaggtgacatgtccagatcttccttcccagcctctggagttggtgcattactcccgtgatttttctctgcctcttaccccaggagttctgcagagatgtaggggtagtgcccatcagggtcgttgtccttgtcgttttattcttattgccaaataaattcatttgtgtgtgactataagacgagtcttccagaagcagctgctgtagtgatgagttcactcctccactgccatggctgccttcgctgggcccccactgcctgcaggacagcgtccagattcccattccagggcggggtcctcgtcttcccccacttcggccctatcttcagacactcccctgcacacacactcatgcctcaggcctcctgcctccacgcccttcttcacggggaagcctctgcggaaggccttcccagctttttctagttgccgtttctatttggaggccttcttatctccacccgagacagagggtcacatccccctcatgctgccactgcagggaccccattcttttcagcgtgagcctgctcccccgctgcactcaggatgcccttgcccttatgggacttcatttggattgtctcttcaacgaagtatcaacaactttgttccataaaagactttgattaactgtttttttcctgctgttcctagagaaaacatttccatgagaacaatgaggcattctgcacgttaggagacgttgaactctaatcggggccataagagtgagtttccacacagaatatcagttaataactaaaacaacagtatttgcccgggtgtgtggacttggtgctttgggtctgtgagtgcccatagcatggcacctgggccggcatcgtcatgggtcggggatgattgacttcctagctttttgtagaggggctttttgaggttagagcaagtgagagcaaagatttttcctaagtactacaggacagaacttcctcatttgtggctctggcactccacagacattaagcggctgtcactaatcggtgcagtgccaagtgcttccttaccttgtagacctgggactgtgacaaaatgagcatcattgtgatgctatcacgcatgcggcaccttccctaaggtgcctaattaagcctaattaattctactgaacttgagaagttcagtggggcaaagagaatagaatggaggttttcaaagctgctgctgcttttctgactacttttccccatagcaccataaacatgtagaggtactttatctggataaggaagccaggggaaaaaatgaagacttttatctcccaaaccaaaacacatttttgctgggaaatataggtggagtgtggtgggggaaggctgatggatgttgtggaatgcgtccttcatatctagaggggaagctttaggaatccttgcagatgagaagaaacagcatcatgttgtcctttgcagtgaagtcagagcaactgacagccctttctgagagtccttcaggacttgcttacacacgtgcttgtgggaatgagacacattcccaccgaaaaccccacccggtcaccactgagtcagacacagaactgtgtcaccctgaagaagtgctgcttcaaaagctgtcccaagaccctgcaagccatgagtctttatggttttgcctaaagattttcctgtgatacttaaattcaaacatgtcattgtggagagaaggacacaacttcatttatttttatttttatttttatttttatttttattttatttatttatttatttttttagatgaagtctcacgctgtcgcccaggctggagtgcagtggcgcaatctcagcccactgcaacctccaccttccgggttcaagcgactctcctgactcagtctcctgggtagctgggattacaggagcgtgccaccaagcccagccaatttttgtatttttagtagagatggggtttcaccatcttgggcaggttggtctcgaactcctgacctcgtgatccacccacctcagcctcgcaaagtgctgggattacaagcgtgagccaccgtgcccagccttttatttttatttttttgagacagggtctcgctctgtcacccaggctagagtgggttggcatgataacggctcactgcggcctcaaccctctgggctcaagtgatcctgctgccttagcttcccaagtacctgggtgcctcctgagtagctgggtgccaccatatctggctaattttttaccctttttttttttttttttttttttttttttgtagagacaggatttcttttgttatattacccaggctagtctcgaactcctggaatcaagcgatccttccacattggcctcccaaagtggtgggattccaggcatgagccactgctctcagccctagacacaattttaaagttcactatatatcactcttatactgggtcaaaatagtttccttgattttattttaatttttttaattttaatttttcaagacagagtctcactttgtcgcccaggctggagtgcagtggcatgatattggctcactgtaacctccacctctcaggagcaagcaattctcatgcctcagcttcccgagtagctgggattacaggcatgcgccaccatgcccagctagtttttgtttgtatttttagtagagacagggtttcaccatgttggccacgctggtcttgaactcctgacctcaggtaatccgcctgccttggcctcccaaagtgctgggattacaggcatgagccaccgcacccagccccttgtttttagatattgaggaatgcataactttttattatggtaaaatacacataatatgaaacttatcttcttaataattttcaagtgtactgttcagtgatgtgttaagtacatttacattgttgtccaaccatcaccactgtccattttcagaacttgtcatcttcccaaactgaacctctctgcctattaaacactaacttgccattccctcctctccccagcccctggtaatcaccattccactttctctgtctatccttttgatgactcaggtacctgaattcaatcgtatagtgtttctccatttttgactggtttatttcacttagcataatgtcctcaaggttcatccatgttgttgcctgtgtcagagtttctctccttttttaaggctgaataatattcccattatatgtgtatgtatatgccatattttatttatccattcacctgttgattgacatttgggttgtgttcacctagaactcataattgtttaaaggcaaaaacaaaataaggctctgtcctttgaaatttattttttattgttgttgttttttaatgcaaatttatgaaaaaagtatcaaggttttttgttttaatttttgtgagtacgcagtaggtgtatcgatgtccttagaaatttgtgatgatagaattatactttgtaaatgtgcatttttgctcatgtttgtaaccccagcactttgcgaggccaaggcaagtggatggcttgagctcaggtgttagagaccagcttgagcaacatagggagacccccatctctacaaaaaaaataaaaactaaaaattagctgggtgtggtggtgcatgcctgtagtaccagctattcgggagactgagatgggagaattgcttgagaccgggaggtgcaggctgtggtgggccgtgatcacgccattacactccagcttggatgacagaatgtgaccctgtctccaaaaacacagtgcatttttggacacttcaaaatacaggctcaattagttttctaagcagttacttcatcagcatgtgactggtattatttttctcacaattctgttactttagtcaatatttttatgctttgctttactacgtaaaatgttggattcttccccttagtaattgtctatgcttttctccagactcattaaaggtataaattaaattctgagttttacaccatgtttcctttggcagtggaattaaaattgggaaaaatcatctatattcatagagattaatggtgaagtctcttaaattagatacatgtctataaatatatattaattgttttcttttgctgctttactctggagcaaattttccaaaattgtaacgtgaagtacagtttagaggagaaacatctactatcagaatgtacttaaagagaccaatcttttcacctctttgtagtaaattggatgtttacattgtcatgagggtatctctcttggaagaaagaaattattctttattctgaggtcagttatagacagtttcagctaaaaattatgaggaactgattggttatgtctaaaactttgagttgggtttttgatacttgacttgttttgtatattcgtgactataattaatagcatctgcatggcaggtaagctatgttatccattgtgaatacaaggaaacgaggaaaaagagaccagaagtcttagggtccggagttggcagccatggatataacacgtggatagaaaaacacttctgtggtctttcaacaaggtggaattcccgacaggcaagaaaagccactaaagacccgaaggctccaaaacaaaagaccagctccaggatgccaagatcttccttggaatccctggacccccagatgtctgtaacttgcctccttatacacacctcatttttactgtctttcccaccctgcctggatactcttatttggttcagggggcaatagaaataagcaaagtcagccacatcaacacttaggctttctagcatcgaaatacagatgtgcgggcgtcattccagccacagcacttagcagtgacctagagaaacagatagcgcccttcatctctgatccatcctcctgaggcacagccctggaagaagcctttcctctgtgaagaaacctggggggagggttgctccagatccccagcctcctggccggccccttggtctccctcttggggcatgtcgaaacccagtctcccccaggtatcgcctgccttttgctatcccttggctgtgtgtgcaaccttagtgggtggaagcttatttacagtctgtaaagacatcaggataaaatcgtctagaacttttgaaaccagttggtgactgaaaaaattgctgcatatttttgttaggagtgctttttaaaatttgtttatggtattgactagcagtgaataattgctttattcacaaaagttcacttgtcctcagatctaggtggagatttcaggaaaatatgcagcttcagaattgaggcattgtaagttacttagcacctagcttctcctgaccccccaccccaagaagtaagcttgaatccaaaacacttagcttttcaactgccagaagaatggacggcattagcttcaggctcactcttggaagttgttcttgggttagccatgacatgcagctggctagcagtggattcaaaggctgtatgctgatgtgcttgtaaccagtgatttcttctcactggttttcctagcagtttataaagctttttggtgtaaaacagttggcaaaccatttttggaacaagcccagtagtaaatatttttggctttgtgggccaagctactcaattctgccctgtagcaatatgtaaaccaatgggtgtgactgtattacactaaaactttgggtggtgggagggggaaagaaagctggctggattggctcactggccacagtgtgccagaaaatggacagattaactggaatgaattgctgttgagttctactttactgtataggaaaatctaggttaataaaagttacagaatgtaggccgcgcacggtggctcacgcctctaatcccagcactctgggaggccgaggcgggtggatcacgaggtcagaggagttcaagaccagcctggccaatggggtgaaaccctgtctctactaaaaatacaaaaattagctggacgtggtagcgtgtgcctgtaatcccagctactcaggaggctgaggcaggagaattgcttgaaccaggaggcagaggttgcagtgagccgagatcgcaccactgcactgcagcctgggtgacagagcgagactctgtctcaaaaaaaagaaaaaagggaaaaaaagctgtagaatggatggcattcaagctgttacggagtcagtcaatacacattgggaggatactgtgtttagcactgagtagtgaatatcttaacatacacggcatggtataataatcggattagggctatgacaaaaaacagatacgtgttagcaaggatatggagaaattggaaccttcatacaccgatggtgggaatgtaaaacggtacagctgctgtagaaaacagcctggaagctcctcaggttgttaaatgtagttatcatagggcgcagcagttccactttataatagccaaaagtagacactgatgaatagataaaatgcggtctgtccatacaagtgaatgttactcaaccataaaaagaaatgaagtactgctacatgctacaacgtagataaacttagaaagcatcgtgctaagtgagagaagccagacccaagaggccacatattgtattactccatttatgtgaactgtctaggacaggcaaattcatggacacagaaagtacatttgtggttgccagaggctggagggattggaaaccgagtagtaatgagcacaaggtttctttcggggttaggggaaatgccctaatattgatggtggtgatggttgtacaactctgaaaatactaaaagccatgctttatttgagtgaatatatggtatttgaattacatttctataaagctattacaaaaacagtctagttccaggattaatgtatgagaaataattaataagtaatttaaaatggtcaaaaattattgtctggttaaaggagatctagaaaatgaatcagtatcttcaggtcccctgttttccattgtgtgtgttctcaagctttcccattccctggataaacaggagtcgtgtccagggaaggcaggccagggtgaggggtgtagtgcatccctgatcccctgagtggtaataaggtcagcccccagggcccattcccgccaagtgtgaggtatgtctgctgcgttccgaggacctgctctgcctcaggaattgctgctcgtggaaggctcatggaacatgcttctctgttacagattgaagagggcagtaaagccgcggcggtcgacaagttactggctggagatgagatcgtcggcatcaatgacattggtctctcagggtttagacaggaagcgatttgcctggtgaaggggtcccataagaccctgaagctggtcgtcaaaaggtaagatctgagcttcctcccacatttaccacgacacacaggaatgagtggaacatcaaagtgggaagccagttgtcctgcccacatcactacagagatctcgattgggacatgcacttagagttatatgtctcggccaagcatgggcccggcatcaagagtctgaacggttcctaattttattacgacgatttttataaattttaatgtattaagtggatttgaatactcgtatctttcctttgtttatatgtagattattttcttggcaggcagaaaacggtgcttatgctcccagtgaggtgacatgttgttgcctgtcttgtacacaaggtggcaggccactgcgctttctgttttcatgctagaaagagagtgactgtcacgaagatgccagccaccaagggtttagagcactgtgctgaggtctggagggagggtctggagggagctgtctgtctattcctgtacattacgtgtcagttggagcttggatggttttaagaggttagaaagtgaacttggggacatgatgcttttatatacaggaactaaagcaatactccaggtaccacaagagtgttggtgatatgtcgctttcaaagagaaataactctccaccttggttttaaagttggcttattaacaggcaagtgcttacacatccctcttgacaaaattagcatgttcttttgaaggctggctgtaaattttaattaattgacccacatttatttccatttttagtacagacatgaagatatcttccttgttttgaaaaaacaaaaatttttttttcaagtctggtcaagtgaagtagtgtgcgtggagaggaacaaagaaatctgtaactggttgtgactaattatttgtaaacaccgctgcactcaaaccagccaagacaaattcctaaaggcttttttgaagtgggggtgggtggagatgccaaaacagtatccaaagaaaagattcagaaatgaggaagggccagacgtgctggctcacacctgtaatcccagcactttgggaagccgaagcgggaggatcacttgagcccaggagttcaatcgagaccagcctgggcaacatagtgggaccccatctctctctcaaaaaatttttttttaattagctgggcatgatgatgcacacctgtggtcccagttactcgagaggttgatatgggaggattctttgagcctgggaggtcgaggctacaacgagccatgattgtgccactgtattccaggctgggtgacagagcaagaccctgtctcaaaaaaaaaaaaaaaaaaaaaaaaaaaaaaggggaggaaggaaaaacattttttgcctcatgaatttagcaaagtcaattgtaagtggtacatgctattcctgagcacccttttaacaactctttgtagatcagaaagtaaaatctcagaatggtggtttctgagccattggggagggtggggcacaagaggcaccatgacactgtgttatggttcctctgtgatcaccgtcttaaccctcctatagcagcacgtttgttcttacacgattcagttaacttagtggaatgccggtggtggtgagggaagcttgttctgcagaggtaagacgaggagttataaattggctctgggggtcatcatcccgctgccaaggctgactgcaactcccttttcttctgtctcctgtactgtctcgttctgggctcccagagaccccaaaaacactgggctgtgcttgtggtcttactgtgtgtctcttctttgatggagacaccagcttagtcagcatagctggccaactttgtatcaccagggcatagctatgcgtagaaattcctagcatgggagttcctgagtcggaaggtgtgtccgttgtgaatgttcagagacatttctgagtttctcagaccctttcacatcatctctagcataggatatttgtagtttgtttgtttgtattctctgaatgtgataggtgaaatatggttttctatttacatttgcatttccgtagttatgggagtgaagtcaggtatcattccatatgtttagaagcaaggtagatgtgattctttttttgagctagaagtacatatttagtgataaagatagacagtctaaaatctgttcaaaggaaagccatgccacaggagaactggttggtgggaggagagagcgaagcctcagggcatctgctggctggtttcactgagtaggtacttaaaagactcttgggaaaagggattaaacttttgccctgaaggatctccaggagccactgtgtagaatccccattttgtgttctgcagacccactttcctttaaatgagagatgtggacaaaatgataatgtggtttaaatagaattttatttaagtagtatgtgtaacgagatataaagcagcggagtttatttacaaatttttatttcccaacacactttcaataaccgtgttaggaaaaaacccacaagctgtttttcctctgctctcacacaacactcaacacagaagacttctgtgaccaaatgtgcatagaacttctaatactccaactacctttatgtggttttccttactacaaaagcaccaatgggtgctttcaaaattgttcttcttaaagccagaacacgtattcttctctatctaaatttaaatctctatttaaatctccccgccctcctctttctccattcctaggcaaccactaatctgccttctgtctctatggattaggtagcattttctggcattttatgtagagctccaggatggagcatgtacccttacaagtggctagttcatgaaaggaactctgcaggtagttcatagattgagacaccaacatattcatattctatattgctctgcttaaaagcgtgatcaaatggtaaactagcttgcccaagccttgtttgacttgttgcaattgtctgcccccatctgcaaaaatgtgatgagggaaagaggtatatacatctctgtgtaaagcacaggaatccgtggttttttgtttgttaaagacaggttcctgctcttttgcctaggctggagtgcagtggtgcgatcatagctcactgcagcctcgaactcttgggctcaagcgatcttcccaaagtgctggaattacaggcgtgagccgtcgcacctggcctctccatggttttttaaacatgatttgaatagtggttcacggataaactcccctccctgtagtgacagctgctacacgtcttattttgtaggctcattttatctttgtatgtgtggggaccaggggaccaggcagccaggataggattgcgatgggccactttcacaaagcggtggcatcttgtttcacaggcatgggcaacgtggaccttgtggtcgttgagaagctggtgctgggaaagcgatgcgggaggagacaggcggatcactatctccgcagacaaatgagggccagcgcttcctctcgcccagggcagtgggagctggagacaaagaacttgtaacaatcagccctaccaagtgcatgtatgttcttccttgtgaggtccaggtggcatccacggcccgagatgtcaggggaggggtgctgcccaggagtcagatctgtcggttaggtcaggaggagaggctgaggctggcagttttgcttttctctttcttcccaggcggtttgttgttctgtctctacttggcaggggagtgctccttgcaggaaagttcagggcagacatgtagccttttattatgtgtatgtgtgtgtccagtttttttccactgcactgttttcctaggtgcccaggcccacccctggagagtcctgggcaggtcttgaatggatctgggctctggaatcttcacacagagccacaggctatttcgctgggcattagcagcggatctaccgcttgctggccttaagcacaagttcttgggaaggttaaggccagaaaccgggtgaccctttggcattttcctcattaacttagcccagttgggttagtgcaaaagggaggtctgcctgatgccctcaagctgctccggaggagaggaagcagggttgggagggtggggaaggaccgagaaggggacggcagctcctagcttagctgggctcatcctatccactcggtgccagggaccgtggctgttgcctgttgctgtcttctctctgaaatctgcgttaacagctctagggacagagtcatccatttttctcccttcagaggcaaatggctgttaagttcagcttctaaaaagcacctgtaatttcaaacaccctagggaaaatttcttttaaatatcacatcataaattattttctaaagctttgcaattacccttttggctttttccccaaatatgcattataatattagttttgtttacagcaaatccacctgccaccttgtcacagaccccactctgggcagtttctcttgaaccggtcatgtgttgcgagtcattttgtgggggccaaatcgtggatagggttgattcatgtcacttcctgcctctttgctggcagccctaaaccctcttgtgaatctaattacatccactaagcttgcattcaggagcagcttagcagcagagggaagggttttctgcatcaggctgcaagggtttgcgagaccatgtggtgtggtcctgcatttgaagagaagaggctgcatgtcgagggagagcactcatgtttgctaggagctggtttcttacaacatgcgtcccgtcttgggcattgctaaggtgccctgactgctgctccaagcccacattgtgctgtgcccccctctgctgctggctccttggagctgtcctggagcaggtggccctgcagccctaaggttgattagcacagatgttccgggagctgctactcgcaacggtggcagcagtaaggggccgcctaagacgtcagcaggtttacacccccaccccactcccccagcaccccaccccctccagaactactcctgaggcagaaatggtgcatggtcagatggagggcatgctccttagtggggacactggaggacgtcaggtgaaacccatgccttcgaggctgtctgatgtctttgtctgtgattcaggagtgggtatttctattctgtgagcatttggggtctaatggctgtttgctactgtgcttattttcttgttaaaacaaaggagaccctgactggtttaggctattttccattattgtttttatttcatttatttattttattatgagtgaaggaaagaaaggagagagggagggagggaggatgggaaggaaggaaggatgaaatcttgctctgttgcccaggctggagtgcggtggctactgacaggcacaatcatagctcactgcagcctcaaactcctgggctcaagtgatcctcttgcctcagcctactgagtagctgggactacaggtgcatgccaccatgcccagcttattgtttttatttttttttatttaattttattttttctatttttttgagacagagtctccttctgttgctggagtgcagtggcaagatctcggctcactgcaaccttcgccacccgggttcaagcgattctcgtgcctcagcctccccagtagctgggactacaggcgtgtgccaccacacctggctaatttttgtatttttagtagggatggggttgcgccatgttggccaggctggtcttgaactcctggcctcaagaaatctgccccacttggcctgccaaagtgctgggattacaggcgtgagccactgcacccggccagcttattgtttttattaagtaaaatcaggagaaaaaagaaaaccacatagatcagaattgttttattttggggaaagttacttctattggggttttgccttagtgtgtggtttagctaatttaatcagatgaatcaatgtttgcaaatagtgatggtttctaatatagtaagacttacagagaatgtttagcttatttttgtgttgttttggggtctctggaggacctgtatgtgctatgcagtgggatccacactgtacaggttaagtttattttgaggttcaaggaattgagaagttagcattagccttaacgatgaagtttaaatgacttttatttttttatcggttccacaaatgatgtagacttttattttttaaaacagagcagctgtaatgagatccaccaaattgaaagccctgagctttaggagaaaaggttgatctacactggttgaattcccagtttgctattggcttggaaagaagagtgttctggtgagattttgagagcagactctgggaatgtcctctcttgagacttgagggcgcagggatctggggacaggtcttggtgtctgtcatctgggaggtagtgtcctgcgagaggcagcagcccagcagacaccaagggcccctgggatcacgtgctgacctcttagtgggcttagcagggcaggaggcccacatgtggcttctgtccagtgtgccactcgcccttgcagtcacccctaaaggacaggtagatgaggcctttgcaggtcgagacgtccccaaaggctctgtctgtcccacatggagcacactgagcgggtcccctctctgtccatcccgtccttggctgtggtggcactggcacgctgtggcatgctctgccctgcactggccgctttgtccagatggagacaaacgtgctttcagtgtgttgccaaggggcagggagaggtgatattggcagagccatgagcgatggctgcccggcaggtcataaaggcggagtaaatgtcgcctcttcttagaactgtcacctcaagcccggttaccactaacacccattggttccaaggtgggagagtttgggggaagaaatgaagtacccgacacagccttggccctttctacaaagtgaggggcataccttatctgtaacaaaagcctgttttttttgttgttgttgtttgtttgttttaatgtcacttgctaatttattcacacaaagaaaatgctccataatgaaaacaacttcatcccatgtctccctcccacccacacacactcaaacccctcctgtccccaactgcaagatgcgttcctacgtcttggctatctgaaggtacttttagaaccaaatcctcataaaaaccatttagaatagttgcctgataacttggttttattgttaaagaaagcctgtttgtggcagttagagtccaaaggcctttggaatggaatggagtggcatgtttaaggagagtgctcagaaggctttgctgaatggtagtcatgacagcattgatggggaggtgaagtgggctgattaaataactcgagtagttccgacgtccagaccatgttttggtaaggtagccagcgtcatggacagggcaggtagcaacagttctctgcaccacggagggtagttgtaccatttactctgctggttgtgggtgtgcttgcctttaatagtacggaaagcaaggtcattggtctgcagttatagtaaatgacaaagaagaggaaggaatcagatctttcttcagtgatttcactactttgatttgccaactatgacatggtggtttattaaatgtaaagacacagaggaatgttctctggctcaatgcccttgcaaagaaaaggatgcctgccaccctctcggtgagatgataagtgatcaaataagggaagatttttatcagccattcggcatatgtcgatcccatgtgagtggacgtctggcttaccatagtgaccacatgtgcagtggtatttaatagttctctgaatgtgtataggatctgtaaaaagtttggaataaaagcacaagcttcctttggagaaatgtgatttagttgtaatagcatttcactactgccacattcagttcacctgtggtggtagtgcctgtaactttgcattcagaggaattcgtggaccttcctccctctgcctccccgattttgccactgagtttcatctcttttcatggtctgggctcaatgtttctttgctgtgctgtgactgtaaagtctcttttattggttactttccctaaacctcgtatctcttctctataccttggtttttgtttttctatgaagagtatcttcttaactcttctagtaccttgagtaaccatgggctctgggaagggaatttgaggacaaattgagtaaaaatacagtaaattattatgggctttatgtaatgagcagaacatcagaaagggctaggtggggatattgtttgctgagctctagtgggcagaattccacaaagggctaggggagattgtttcttgaaatctctttcctttccctttgcgtctatttacatggctagagcgctttatacatagcatagcatttagagaacagcagtctgcaatcccttgttgcttttttttttttttttttggtatggcttttgccatgtgtatactgatatgttgactcaacaagttaaactttttgtgtcttttttcttatatccgtggtgttcatccttagggctatataaaacgagtcatattaatgactgcacacttgaatgtgctgagtttctttgccaacaaattcattctgttgaaacatagccaggaaattgtgtgggtgccctttttaaaacatcaagctgaatgaaatgatgatttgacacctggggcatatatatggttgaacacaagtggtttggatactgggacagcgatcgtctttttttttccttttctttccaacagtaatgggtttatagaaatgaacattacagaggttaatgggaaaaacaagtcattcgggtctgctccactcctctgttctgtgccgctcggttctgcctgtggcttctgtggcattcctctgcagtcttttctgccataggacccaggttgaacaccagaggtggaggccagaggcggggcacgctcttgctaggggtgaggcaggcaggctggccaggtggagagcaactctggggctctcaccccacgtgaatgctgctgctgggccctggcgtttgcttacaatgaggctctgatgtctcagtttcagctacttaggtcatttgggaatttttatcttgcctcagttctcttcatgtttaaaagcaggaactacttgcctcttatctcctaggaccatagactttatcagacatgatgtcaccattcacgcaggcattgccgcaccactgcctgggaaaagacactgcatataaatcttcccacagtgcctttagggggcgacttttcttatagaaaatacatgcagagttaaccatttctagagtgctctggcgtacttgtatacattcatgtgatgtatgtgagaagcactcccaccacgtggttaaaatcattcctttaggtcccgtcttccaggagcttgcagctgagtgggctgaagagctctcacaagtgcggactcagagaggaaggaagggtggaagttgatccaggaaagtctttgctgaggacaggccagcggagcgatcctttgtagctgagccagttttgagaggcagatataaacgtctgccagccatactaggtgctccaaagctggaagccatagctggaagttctagtgagaacagtagagggggaggcttgggagagggaggtggaaacgtaggatggggccagcacccagtggctcacacacagctgctcaggtggtgcagacactcctgtcccactgcagcccagacttccttggtcttggggaaatgagaatttgctttatctgccaagaccctagatgctacagacgctgccggcccagggagcatgctctgagaacccctggactagaccacagagaacctaggagcatggacttccttttgtggaaactgggagcagctgatggttctagagtgagggcaagacctggccagggctgtgttgcatgcagggagactgatctggcaggaggtgcaggcagactgggagaggaagaagccttccggaggattggcaggaaaaggaaggaagcagagtcagagctggggttcatttgatgtttgcagagaggtggtttttgtttaaaggattagaagagtgtgagcaattgccaggtaaattcccttctccccagaccctggggtctgacatcaggaagcttgtcacagtccctgaggcccccagactgtttccagggcttcccatcctggaccggtatctgcaaggcctttccaactgcagactcttctttcaaaacctgctcttccttatctccaagaagcccttagaaactattatttatctgttttcccacaaaacgttcctcagctcccagtgtaggccaaaagccccccacgtatgtaataccaccaacaccccccgccccccatcgcagtttccaggcagggggaccaggtgggcctgtgtttcagaccgtaggctcccagcaggccaaggcgcctcccctcccagaccctgccttggcctccagccagtgctcttactgtgcacttagttagctgggggcacgaaacacaaactatttgtcttgggaggaggtgcttctttgctttcttctaaaaggttaggaaaataacccaacactcgtgattttttttttcttttctttttttttttttttttttttagtttgagggaagggaaggaattctgctctttgtgaataataaagatttcattgaagcagttcttgtaataattccttttaaaaataaaacaggatatttgatatctaatctgttctttctttttttttagagatggagtcttgctctgtcacccaggcagaagaacagtggtgcaataatagctcgctgcagccttgaactcctgggctcaaacatacagctgttgttcttaatgttcaatgacatcctagcatttttttatatttgtgttctaaaccctgtcctttaaaaaaaaaaaaaaaaaaacccaaacactacctagcatataaaattactctaaaaaattgaagtaagtttcaatgaagtttggtatacaatccatggggaagggatttcaggggaacccaccattagaatgaatcattccatctggagtaccagaaaactcgatattgtcgataccatggtgttttgttatatgaaaggaatagtatgcattggctaaacattatgttttggaagaatgataatggcctgggctgggtgtggtggctcatgcctgtaatcccagcactttgggaggccgaggtgggaggattgcttgagcccaggagttcaagaccagcctgggtgacatgatgagacttcatctctttaaaaaatttttgaattaaataaataaaatttttaaatgataatggcttgggagaatgatcacaaaaccaggcagactggggaaagaaaggcactcgtcaagtctgcaggatgaaagggaatacacagaaacatgtctgtcctgcacatgagacccacggttctagggactaggtggtttaaagtgtttaaagagtgcgtggcttgtgcaggaggaaacaccacagccttcagtctactcaagtccttctgggagcccttgaaactcagccagagggaccgggagtgtaggcgggctctaggtggcgccagagcactctgtccccaactccacgggtctgtgattgagcgaccagcatgtaggggctgaaggtcctccccaccatctccttatcaacaccaatccagccatttcagaggtgccaacaaacagaaaccactctgaccccggcttgatccccaaatacattcattatgcaccaggaaattcagaagacttgagaaaaaaagcatatatattagtaaattttcactgtccacagtaaccaagatatcttcagttaaagcagaaagagtgcaactcttttcactgtgtgtcttcatttgcttatttaaaaaattatccctaggccaggtacaggggctcacgcctgtaatcccagcactttgaaagaccgaggcaggcagatttcttgagcccaggagtgtgagaccagcctgggcaacataacgataccccatctctcattatacaaaaagttagcttggcgtggtggtgtgtgtctgtggtcccagctactcaagaggctgaggcgggaggatcacttgagcccaggaggtcgaggctgcagtgagccatgattgcgtcactgtactccagcctgggtggcagagggagagcctgtcaaaaaaaaaaaaaaaaaagccacaattcgtataagaactgctgaccgtgtcatatgtaagaacacatatatctgtatattatctttttaaaaagcagcttctgggtttgttttcattttttcattgcctcatacagcattgctcattctcttcagacagtttggaaagagtgtgtgcttgtgcaggaataaaccaggtgagatgcattttctgaaggcatggaagtctcacttccaggcaggttccctgcctgcctccgacaactcccacccaagatgccttctgcacatgcattcccgtccatggggagccctcttccatgccatcagcctctctggctgtgacgcccctgttcggactgtcctatcttcctctttccctggcctgcattttgacctcaaccctgtatctttttgtccccgccgatggacacatccacagggatgtcccatagctatgggagatgcacaatatacactttgggtttttgttgttgttgataattatggtaaaatacacataaaatttaccatcctaaccattgtaatgttcagtagcattaagtgtattcacatcatacaaccaatctccagaaacttgtttcatcttgcaaaacagaggctctatatgcattaaacagcaacttctcagtctcccctcccccaccccctggcaaccaccattctactttctgcattcatgattttgacaaatcaggtacctcatataagttgaatcatacagcatttgtccttttgtaactgtctaatgtcacgtagcataccatccccaaggttcttccatgttgtagcatatgtcaaaatttccttttcattgacaagtaatattccattgtatggaatagaccacattttgtttgtccattcttccacccatggaacagtatacgttttgactaaatggccagctgttaaagtctgtattagatataagctgagtatcatcattatagaataaacttctaaggtaaaagtaaatctgaaatgatattattattacaattttgttttaaaacataatgttccgatttcaacagaatgattttggtccaggaacgggattgtttagccttctcagctgctagaaggcttctgtggtcactgccttattcatttgcaacactgaattaattcttattttagcctgaggccagtggaaggttgagatgtattttgggttttttggctaactgctggtttaggttaatgttaccagcaagctgctgtctccccgatgtaactgaccaagctaaagggctaatttctcttcatacttggatttaaggaatcggtgcatggggatgattcattttatttgaaacagttctgcaaactgaagctttgtgtacatggggaggaagatacttcctggatattttcagaagcagatttaaggccgagcatggtggcgcatgcctgtaatctcagtgctttcggaggctgaggcaggagagttgcttgaggccaggagtttgagaccagcctgggcaacatagcaagacctcatctctacaaaaaataaaaaattaaaattattatgtttttaaaagcagatttaagatgattactctccattttgatcatctttgctgcatgaaaagtggccccaaaattagtggtgtcaaacagaagttctagttgtaaaattgagcacaaagcaattggcctatacggaggtactcagaagcatgctatgtgttagggctggctatttcaagatttaaaaatatgctctagaaaatctctaaaaggtagttatctgcacatgatagaagggttggggagggaggcggtgtaaacagtcactgtgctagggttgcaggcagcagacagtcgcaggggcgtagcagcattcctgccatgcagctgagatggggttactacatctctaagccagtgctccagctgcagggctgcagatgttccatatctgtgctgcccaggcagtagccactacccacatgtggccattgagcactcgcaatgtggccagaatgaccaaggaactgaactttggattttgtcactttgaataaattaaccacttatgaataaggataagtgacttccctcctccctcttgactcgtcagtggctacacccgggattgatgtccatctgtccagggccaaagctaggaatagaggcagggcacagctgcgactcactctctcccttcccccatgacaggggccttccgcggggctggcttgagcagcagcagatgcccagaagctttgggccttggttctggctgctggctgggttcctcagtctttttccacgttgcctctgcaggggccatacgtgcaaatgacttccttctctcctgtgtctggtgcgtggggccaggaggttgggcgacagctggggctgcctggtgtcgctttccatacggccttatccacgtggctcacttgggcttcctcatgccatggcatggcacggtcactggattcctcataatctgtcacacgtatatattttttaaaagacagggtcttgctctgtcccccaggctggagtgcagtagcgcaaacacggctcactacagcctcaacctcctgggctcaaatcatcctcccacctcattctccctagtagctgcaaccacagatgcgcgccaccacgcccggctgatttttaaattttgtgctgagatggggtcttgctatgctacccaggctgatctcaaactcctggccgaaagcaatcctcccacggcagtctctcaaagtgctgggattacaggtgtgagccacagcacccggccatttgcatgcatactttgtgagaacaaaatctgttgctaatattcttatatgtgcttgctaatgatagtttatctgggagaacttttattgtacccatggagaactgctgaccctctaaaccagctagtagcccagttattcccgaagcagggctgaactagcgtcgtcttgagtgtcagacgttttcttttcctagccttctctttttctcccctttcctccagtttcagtcagtctagtttattttcttcattaattaactataaaggaagatgaaagaagttgtggatgtcatagcacagagaaagccagctgaaaatgaaattcacatggccagaaccttccttacgaggattttgagaaattccatgaggtacagtctgggttttacaattgctttccttccatggggtgctgaatttgtcttttatactttctctttggttcctgggaaactgtcataaagtcagcatgttccacattttgccacccgtatacttttcctcgttaaaatgatctgagtcatcgaaaggtttgtgttatacatgcttttcagttttattttgtaaaatgttctttattgcataatgttctttaatgtttttgcctgctgggaaaaacatctgatctccacaaagtatttaaagaggcccgcttgagctcgttctccattcttgattgggttatcagctgtcagttctgtcccaaattagagaaatgtaaagctggcttcctaccatgaggctggagaagtgagctcgggaggaggatctcacgcccagcagtgttcccctggaggccctattgcattaccgacatccattgggatttctaaccagacacacctcatcacatctgggcagatgtggccaagacactaagaagccacacatgggatggtggggactgtggcgggggagcccaggaaagctcgtccatattcaggagccctggctgaagggactttagccttttggtgtgggttgtcatgactccctggggggatctttggttgactaagaggctcaggggaagatgcggctactagtcttagttaaccagaaggtggctgtctttactttgttacctaggtaaatagacacagataagctgtctgaactgtgtgtgacccagccgcctgagggacccatataccttttctccagcaaaagataggagatgctgtttgtgttcatactggggcagggagagggcaacatttgcttacttatttatttagaataaatgttctttatttatttttacatttgtaagattttaaattgacaagttaacagttgtccatatttatggaggaacacattttagagataagggctggctgagtgtggtggctcacacctgtaatcccagtactttgggaggccaaggtgagtggatcacttgaggtcaggagttcaagaccagcctggccaacatggtaaaacctggtctctgctaaaaatacagaaattagctgggcgtggtggtgagcgcctgtaatcccagctacttgggaggctaaggcaggagaatcgcttgaacctgggaggcccaggttgcagtgagccaagatcatgccattgcactccagcctgggcaacaaagtgagactctgtctcaaaaataaaataaaaataaagataagggctgctgcacatctagagcctgtgattcccactctgcgttagggcaaatgggtggtgaacaaaaatctaaaaagaaggtgtgggtttggattcagctggcaacccctgaacatggtgccgtgcacctgcctgagttgctgtgatcagtgtcagtctctgcactgtttggcacaagcgtgcgcgctgtgcgcattccctgaaccccctgcactgtttggctcgagcgcgcacgcgctgcttgcggtccccaagccccctgcactgtttggcacgagcacgcgtgcgctgcgtgcggtcctcgagccccctgcactgtttggcacgagagtgcacgtgctgtgtgtggtctccaagtcccctgcactgttcgtttggcacacgcgcatgtgctgtgtgcagtcccgagccccctgcactgtttggcacaagcgcacgtgcgctgtgtgcggtcctcaagccccctgcactgtttggcacgagcgtgtgccctgtgtgcggtccccaagccccctgcactgtttggcacgagagtgagcgctgtgtgcagtccctgaccccccgcctcccctgcgttcttttctaggaggagcgagctgggctggaggcctcactcctggcatgccaccaagttctctgacagccaccccgagctagcggcctccccattcacctccaccagcggctgtccttcctggtccggccgacaccacgcgaggtaggcacccattcccgtccaggatgccaggtttgttcagccttctgcagggagcgcactcctgactgcagaatgattttgatgtttctgatgagactgggccaccgacacataatcacagttggagggctctgaatttttgactgaaccggcaagcgtgtgacacaaaatgaaatggcaagacaaggcatgagcaagaaggggagcataggacttgggtttcagccaagcttctttgggattggccaggtgggatgccaggcagtagggttctgagccggtggggtggcatccacggcacccctctcctttccagggttttacacatggactggaaggcaggagatatatatggggtggcaggtatatcttgtaaaagctcccaagaggttctttaagctttggtagcctctcctcaaccctcttggagttagtggcagtatcctcactagtctcctgttaagaggatggcggtaacagcagatagtctgcttttggtgtgcgtgtgtggatgtctccctgcttgcgtgagtgtgtgtgtgtatctgtgtatgtttacgggtgtgagtgtgtgggggggtgtgagtgtgcatgtgtatttctacacgtttgtgtgtgtgtgtctttgtatgtgtatgagtgttcatgtgtctgttcgtgtgtgcctgtatgtgtgcctgtgcatctctttgcttgtatgtgcatgtgtgtgcacatgtatatgtgtatgtgagtgtgtgagtatcagtgagcatgtttggtgtgtgtgtgtgtgtgtgtgtgtgcgcgtgcgtgcacacgcaggtatgtgtctgtgtttggagctaatgtaaccactcagtttttggctgttaataaatgctggtcttggctgggcgcaatggttcatgtctgtaatcccaacactttgggaagctaaggtgggaagattgtttgagttcaagaccacccgggacaacacagcaagaccccatctctattaaaaataaaagaaaattagctgggcattgtgtgcacacctgtagtcccagctactcaggagactgaggcagtaggatcactgaagcccaggagttcgaggctgcagtgagctatgattgcagcaccgcactccagtctgggcaacagagcaagacctcgtctcttaaaaaaaaaaaaaaaagaaaagaaaaaaaaatactggtctgtaaaattgcaaggtaaagatttatatgacacgaaggaaagacaactgaaatataacattacccctaaagtgacaaaagatgatggtatttagagcccagtgtattttttggggaaaaaaaaaacacaaaaaaacaaaaagccacagattctcaactgagtagtaacacttaagtgaacagtgggccttttattttattcctgaagtgacttaaggtgatgagatctccattaagcccatttggcagtctcttgatgaaagaaacatgcacactgcccacatctgtgtggaaacagtgctcagagttctctagatctgcttggacttgggatctcacagaaaagtcccttccagaatactggtgggtagtcaggagcatgccccgggtttgaggatacgtggtctgttcttacagaagatgggtgggaaacccaaacagtcctctccctcccatagatgacagccagttgttctccagtgttctgtcctggtcacacggttctctcatcctcactctcccccaacctagtggagccacagcttcttcctgttgaagggtgaacatctcagctttgttgagctttaaagaaagcacttaacatcctggataaatagtttcaccattgagagctctcagtcacacacagttattaccttacagaggaatcaatgtgtcaactcaccgtcaatttcatcctcttagacaccatcctgtttaggagcctgtgttttttggtgtgagtgtcaataactctgtagggtataaccagttagctgaaagctgaacacagcagtgtgtgatattattattattattattatctttgaaacagggttttactccattgcccaggctggagtgcagtggcgcagtcacagctcactgcagcctcaacctcccaggctcaagccatcttcccacctcagcctcccaagtagctgggactacaggcatgcaccaccacatccagctaattttttaaaaagtttttatagagatgggggtctcactatattgctaagtaaggctggtctcaaactcctggcctcaagtgatcctccagcctcaagtgatcctcctgccttagcgtctcaaagcactgggatttcaggtgtgagccaccaaacctggtctgtaacaggctagctagtaaatgcttttggctttgcaggccgcacatctctgttgcagttactcagctctttcattatagcccaagagcagccacagacactacgcagacacatgggcacagttgggttccagtaaagcttcatgtatgaactgaaatttgaatttcatatcattttcacaggtgaaataggagaaatagtatgcctcttctcccaccataaaacatataaaaaccatttgggctgggtgcggtggctcatatctgtaatcccagcactttgggaggccgaggcaggcagatcacttgaggtcaggaattcgagaccagcctggccaacatggtgaaaccccgtctctactaaaaatacaacaaaattagccgggcacagtggcaggcacctataatcccagctactcgggaggctgaggcaggagaatcgcttgaacccaggaggcgaaggttgcagtgagctgagatcacgcgtctgcactccagcctaggcgacagagtgagactgtctcaaaaaaaaaaaaaaaaccaaaatcaacaacaacaacaacctgagttgtggtgtggccacccctgcgcttaactgttgattgaccatagacgtgtaaatgcagacgttgcctgccaacgatccgggcatcaggctgagaatgtgcgctagggttgcaaggcatctgtttggtaaaagccatgtaacagggaggacacagtcttttcagcctgtgcccagtttctccgtgtctctactaaaatccagatgtgctgagctgcaacctcagcctcagcaacatcaccgtgggaaattactgtttggcattttggtatttccacagagggtcagctgcgtccaccgccttgccctttgccattgctgttgctaaagcacaccatgccttgtccttcttctcattcttgcagttcttcctcccacgacctgtccagttcctgggagcagacgaacctacagcgcaccttagatcacttcagctccttggggagcgttgacagcctggaccacccctccagtcgcctctcggtggccaagtccaacagcagcatcgaccacctgggcagccacagcaagcgcgactcggcctacggctccttctccaccagctctagcactcctgaccacaccttgtccaaagccgacacgtcctccgcagagaacatcctctacactgtgggcctctgggaggctcccaggcagggtggccggcaggcccaggccgcaggcgaccctcagggctcggaggagaagctcagttgtttcccgcccagggtccccggtgacagcggcaaaggccccaggccagagtacaatgccgagcccaagctggctgcccctgggaggtccaattttgggccagtctggtatgttcccgataagaagaaagcaccatcatccccacctcctccccctccccctctccgcagtgacagctttgctgccaccaagagccacgagaaggcccagggccctgtgttctcagaggcggctgcggcacagcactttacggccctggcccaggctcagcctcgtggtgaccggagaccagagctcaccgatcggccttggaggtcagcacacccggggagcctcgggaagggatcgggaggcccgggctgcccacaggaggcccacgcagacggcagctggccgccctccaaggatggagcttccagtaggctgcaggcctctctgtccagctcagatgtgcgcttccctcagtctcctcatagcggccgacaccctcccctatacagcgaccacagccccctctgtgctgacagccttgggcaggagccaggggctgccagcttccagaacgacagccctcctcaggtgagggggctcagcagctgtgaccagaagctggggagcggctggcagggtccccggccctgtgtgcagggagacctgcaagcagcacagctctgggcgggatgctggccttctgacacagcccttggagccctcgagagtcttcccccacccacggtgggccagagcccacgccatcacctacctcagcctgagggtcctccggatgcccgcgagacaggacggtgttacccgctggacaaaggggccgagggctgctccgcgggagcccaggagcctcccagggccagccgtgcagaaaaagccagccagaggctggcagccagcatcacgtgggcagatggggagagcagcaggatctgcccgcaggagacgcccctgttgcactccctgacccaggaggggaagcgccggcctgagagcagtccagaggacagcgccaccagaccgccaccgttcgacgcccacgtgggcaagcccacccgaagaagcgaccgctttgccaccaccctgcggaatgagatccagatgcatagagccaagctgcagaagagccggagcacagtggctctgactgcagcaggggaggcggaggatggcaccggccgctggagggccgggttgggaggtggcacccaggaaggacccctcgctggcacctataaagaccacctgaaagaggcccaagcccgggtcctgagggccacgtccttcaagcgccgcgacttggaccccaacccaggagacctatacccggagtcactggaacaccggatgggggatccagacactgtcccccacttctgggaggcaggcctggcccagccaccctcatctacaagtggcgggccccacccgccccgcatcggaggccggagacggttcacagctgagcagaaattgaagtcctactcggaacctgagaagatgaacgaggtgggcctcacgaggggctacagtcctcaccagcaccccaggacatctgaggatactgtgggcacgtttgctgacaggtggaagttttttgaggaaacgagcaaacctgttccccagaggcctgcccagaagcaagctcttcacggaatcccgagagacaagccagagaggccgcggacagcgggccgcacatgtgagggcacggagccctggtcgcgcaccacctcccttggggacagcctcaacgctcacagcgcagcggagaaggcagggacttcagacctgccgcggaggctcggcacctttgcagagtatcaggcctcttggaaggaacagaggaaacctctggaggccaggagctctgggcgctgccactcagcggatgacatcctggatgtgagcctggacccacaggagaggccgcagcacgttcatgggaggtcccggtcttcaccgtccacagaccactacaagcaggtaagcatggagccacagcccccttgaccatcatcttaacccaaggacaggacacacccagaatgcagtggctgacgccagggctactcagctccagctgtgcgagcatttaccttttccagatctcctagtgtcctctgttagaggtatttggggacaaagttgacaccttcaaggcaatttaaactgccatattcccgaaaacccacatttttcattctcgttctcgttgccataatctctggctttaactgagtttccccttaagtagcttgctcctaccttcatactcagcaaagaacttggagggagaaactatggaaaatgataactaacgcctctgacatggaaatgtgtggtttatgtaaaagcttaaaatgacatacagtagccacttttcaaacactgatggatgacctttaatatttatagtatttgggtttttttagtattctgttttttatttgcaagtattttcaaggattgctctgggacaaaatgtatttaaaacacattaagtgattgcactttattaaggtgagagttttgatggtgagagttaatgtccagctttctagaaaactgcatatttcttagccctgcttcaaagtgaacagtctctttctctcttgcacctaccccctttgaaagctttttctccctattacatctgcacttgcacatctcaaagaaaaaaatgttccacaatgatagatgcagtttctttttaaaagaatccagggtgggtgcggtggtgcatttgcagttctagtactttggaagaccgaggaaggatgatcacttgaggccaggagttccagaccagtctgggcaacaaagcaagaccttatctctacaaaaaaaaaaaaaagaaaaaaaaaacttaagacaggtgtggcggtgcccaaggaggttcaggttgtggcgaactgtgttctcaccactatactccagcctgggcaaaagagcaagaccctgtctcaaaaaaaaaaaaaaaaaaaagaaccactagtaatttaatacaagatacctaataagtgcatggaaagaaggctgctggtttgctctgtggcgtcccagccctgaaaatccacacagatgctgtgagtgtttatttccactgttggataccctggcttgtggctattcagcatgacctctgagaattccatgcttgctctgtcaggagcaaagaatcccaggctctgacgagtactagagcttgaggcttcaccgctgtaatttgtgaccagctgtattttattttatttcttttggccaattgtgccacacggttttacaggcttcacgtaggagttgtttcctgcccagaacagaagtggacgtggggtcttatttcagtcatctcaatgaaatgctttgtagaactgccctggcaaggcaaacccacaaatgagggctttcataatcacagatgtcctgaggaaggcagcttgaggacttggtgtctcattatgttgccctttgcaggaagcttctgtcgaactgcgaaggcaggcaggggaccccggcgagcccagagaagagcttccctccgcagtccgggccgaggagggacagtccacgccgaggtgggtgaaatttggattcagagttactgaagaggcgtctgagggtgggcttctgtacgatgggtgggtgcttggttaacatggctagatgtctggcttttgccaaacccaaagcggctgaaatccggcgtgatttctagcatccctgacgtactggaggtctgggcagagcctgtgcaccctgcagccctgcctggagacacatcccagggcggggaggccttcttacacggcggtgacattttttggttcttaaaatggctactgtgttttccgcacggtgagactgcttatggagacataatgagaagtccagttgaacatactggagctgcacgctttgcacagagcgccttatggaagggcagctttagctatctagcacacagctgtgtgcctagccgcggcctggaaatcagagttgcctctaaggattgttagtaagaaaggaacagggcaggccttcctaaattggacctagttaatgagttaattttgagctttaaaatagaaatcgagttagtcacctcccaaagagaggcttcaagcatctgcaggaactgtggcagcagcaggagattagagcgttttgtgccataattccagaatgtgcgccgtagccgcttagttgagacaaggacagggttagattaaatacatagtataatctgtgctgggtgtggtggttcacacctgtattcccagcactttgggaggctgaggcaggtgaatcgcttgagcccaggagttcaagaccagcctgggcaacatggtgagatcccatctctactaaaaatagaaaaaaaaaaattagccaggtgtggtggcagatgcctgtagtcccagctaccctggaggctgagctactcgttcaagcacgagaatcgcttgaacctgggaagtggatgttgcagtgaatggggattgcgccactgcactccagcctgggcaacagagcgagaccctgtctcaaaaaaaaaaaaatagtataatcttccccttcatcacacgaggagggcaggcagagagtgtgcgtctctacagaagatgtggtgcaatcttgtttcaaaaaggcggatggagggatgggagtaaatgcacgacagggtccccgggtgtggatttttctgtcgccttgagaatgttgtgtgattgccatgacattcacattaaacactgacctcaaaactcaaggttctgttgcagaaattaccaatttaaaagtttgctttcaagagcctcatgtaatggggttttatttcatttggccttaaacagagctgttatccttctacaaggggatcaaatatttatgtgactctgcaacgacaggattgatattgtgtgtgtgcttgtgtaggaagtctctgcagttacttaacagactctgaggctgaaaccaagaatgcgtgggtcagaaaggccgacgaataatccacctacagaatttagctgtgtctgagaagcacaattagagctttatgactgtggattccaagtaggtcacgtgccgagcaccagctgcagtctgttttccaagccagctcccaggccgttgaggctggccgtgcagtgcatcgtgggcagtgctcgatgggctctgcacatgcgggccttgctttgcccgatgccaccagtgtatcatctgtgcagagggcacccgtgctggtgagagtgtatagctctgctgtgcatggagggggtcgccctgaacagctgtcacgtgcaggctgtgtgtgagtgagtgaatggcactgtcgatactgaaagggtcgagaggaagcggggccccctgcttcattcatcaaggccatgtctcccagcagactgcataaccactccaaagaaattagttccagaaactctctgcttttgagctaccaacccagcaattttcagaattgttgggtgcggttttttttttgagtggtgaggcgcgatgaaattcgagaatatgtaggttgaaaagttgttttcaacttttttcagagactctttaatttctgaaggaccagcaagaaagaatacacttgaaaaatttcaatggagaataatagaagtcaaagttcaggcaagggattgttctttgcccaccaaaaagaaaatctagaatacaaaggtttgaagatacccagtgttttgcataagtttcaaataacgtaaacatgtctgtgtaaatcatatgaagtgctgctctgataatcgatgcgtagcaaaaagtatgtattgtattctgtttggataacaaaagaatgttgagatcggaattgttttttgttgttgttgctcatgtgaaccaaatagagataacattttttgtgaagttcaagatcctgttaatataaagacaagtagggcagattgaagtgatgatactttttttttaagttacatgatgtttcagaagctcagaggagatagagcaaagtgacttctggctgggttatgggagaaacaggtggcgtttgagctaaaatagaactgaacctgagggagcagacccagcacgtttgcttccctccagctcttctgtcctgaacagcccaccgcaccccagcccccacccccactgccatcagaggcttcacctcagacccacaagctcaggcatcatagccagctggagcctgctttggggaaatgctctctcctgctgacttggggccccttgaatgctgggtctgtttcctagtgtggccataacaaactccccaagactgggggactcaaacaacagaagtggattctcccacagtcctagaggctggaagttccagagcaaggtgtgagcagggctggttcctcctggggcctctctcctaggcttgtagatgccgtcttctccctgtgtcctcacaaggtcgtccctctgcgcatttttgtatcatttcttcttataaggaccccagtcctattggatcagagccctccccaatggccctaattacctaattttaccttaattacttcttctaaggccctgtcttccaatacagtcacattctgagatactaagagttatggcttcagcacattgattttgtggggcacagttcagtccctaacactgggagaaatgtccctgcttctccattctacctttatagtaaccacttctacctgctgtcagctctctcaggaagtgtcatcctacccttgagctgatcaggctttacgttcatgacagatgtgaaagcctttaagatgaagggaagagggagctgtcaccctgtgggtggcacagaagaggggcatttggcaaaacctgactggagggctttttgagaaacctgtctggagggttccttggcaccatgcaactgaaggctgacagctctgcacaccttctggttcagtcaatccatctttaagagtttaccttgaaagtggacatccactgccccatgaatgtgctaacctcttcaaactgggatggtttggcagggggacagtgactcttaaactcacatcacggatgtatttgtacaccttcactattccttgctgtctgctgggctggaccgttggctcctggaagatgggattttactttttcatttctcagtaccccgtacctgacataattcctgcacagattacatgctcaataaatggttggatggatggagggactggtggatggacagatgggtggttgagtagacagatggatggaccagtcctcaggtagatagttggagggtggggagggtgggtggatgaatagttggatggatggaagggtaagtggatagatggatggatggatgcatggatggatacatggatgagatgtagggatgcatggatggatagatggatgaatggaagagtaagtggatggatggatagatgggtgtgtggatggatgcagaggtgtatggatggatggatgggagggtaagtggttggatggacgaatggaaaagtaagtgggtgggtgggaggatggatggataagtagatggatggatgaaagggagggtgagtgggtggatagatggatggatagaggggagggcaagtggatggatggatacatgggtgcatggatggatggaggcatgggaaggtggatggatgagtgaatgggaagatagaaggatgggtaggtggatgtataaacagatggattggtggctgaatggataaataccaggctgaccttccttgagttagtctttcttgattgtggtgaataatctttccatattggtacattgtgtgtcctaaaattttatttagaattttagtttacacactagtaagtgaaatggcctttatttatccttctgcactagcatggcatttggaatcaagaagacataaacatctcaaaataaatttggtagcacagatttgttttgggtatgagattttagaccttgtaggaaagtttagaggtaccacatttgttcgttgctcctcaatttcgagaggccttgggtgaggactgtgttctgggtggctccagagactggcactgaaatgagatctgggggcggccccctggagctgtgggtgctggcagtgtcttccttctgtgccttcttgcagccacttccgcccccgcctgcaggagccactgccaagcactgatgagctggcactgacctcaggcttgtattttgttgggacagatgggaggggaggcaaagaaagagagtatatcctaaatcccaataccagctgcaaaattgaatgcatacgaaatagagctctttagggaaaaatttgctttcatataatatgtataaacaagctaaatgaacctgagggtcatcttcctggatgttttccctgagaggtgacttggtgtacagagattcatgtgaagaccaatttttcatttacaaaacaagctccttcatgtagatttcagaataagtaacagagatttatcatccaagctctccccctcatttgtcactttagggcagatgtttgctttccctggccttcaattagctcagggcaattgaagctttccattctgagctgctgtgctaggtaattatgaatagactgtgctggatcgggtcaggataaaaaggtgaaacttgatcttggaattttgtcagggcagagcccagcattctgcatagctttgtacagtgtagtactgcatgctgagcagaaaggttcttgtgcagggagtacttgcggatgtaacaccctcaccccagaagggataaacggtagctgtaggagagagcctgcggcatgggtctagcggacttccctttatgtctttttttgatgttgttttttgagacagggtctcgccctgtcacccaggctggagtgcagtagtgcgacctctgctcactgcagcctccacctcctgggctcacgtgatcctcccacctcagcctctggagtagctgggactataggtgcacaccaccatgccagctaatgtttgtattttttttgtaaagatgaggtctcaccgtgttgcccaagctggtcttgaactcctgggctcaagcgatccacccatctcagcctcccaaagtgctgagattacaggtgtgagccaccacacctggccttgtttttatgccttactttgcaactacaatttccccttacatttatacccatggggactttaagaaacccaggaccgagacaggcggccacccgtttgtttactttttggtttggtcgcgtgattctagattatttagaaggaatagctttcaggtgatagtttatggttacaggatttcggctaaggaggagaagcgggagcagggaggcagatccacaaagccctcgtgtggagggagaagtgtgcaaaaggagggtgaaagtgaccaatgccccaagatgccagagctgagggaagccagagggaaatgcagaggaaaatttaactcaggcatctcagttctagatggggcaggtaagcagtcttctacaaacagaatttgtgtcattgagcagggcacagtggcacgtgtctctaatcccagcactttgggagtctgaggcaggaggatcacttgagtccaggagttcgagaccagctggggcaacctagcaatactctatctctacaaaaaatacaacagttgctgccccatggttgggtgccaacatacgtagctgtactcgcacaggatccttgatccctcatgtgactcctaggctgtggcctgagacttgcctttccagaagaatccagccctgtggaaagctgcccctttgtttcccagcagccccatccctggagcccccagcggcctctcttgggggagagactcccgtagcacgtgctgacgtggcagccccgctctgctctgcctctcctctggcctcctttcttgtcagctggctgcgttcttcaaagctctcagcctctgggccgaccttggctgcgttcgcatgttacgggatcctttggggctttcacctttctccagagagctacctggaaacatagatgtccattctcccctttagcttcttccagcctccattcctcttggctgtgtcctagtccagtcctccacccagattgggctgaggtgacacagacatccacccagaaggctgtacagattgataaccgattgattcattcaaagggtcttgctctgtcacccaggctggagtgcagtggcacaatcatggctcactgcagcctcaacctccaagctcaagtgatcctcccgagtagctgggatcacaggcatgcgccagcacacctagctaattaaaaaaacaaaaaaagtttttgtagagaaggccttgccatgttgctcagggtggcctcaaactcctggcctcaagtgatcctcttgcctcagcctctcagagtgctgggattacaagggtgagccaccacaccacacccagccaatgtgttcatttttaaagtttgacttaagagtcccatagattcagtgtcttatgtggcagttaggtccttgcagttagtctcagaaatcgatttagctcatctgttttctgaaggcccacacatttgaaataaaaaaggaaatagttctgagtcacctccttctcaatataaatagaaaatgcattcaaatattcccacaagttttgtgtcttttaaatctgcacaaacccaaagaattcctagaggaggccgccagagctagcagcacgtgtcaggtctgcatcccaccgggccagctgagcaacccgcttcaggcccctgcataccacacagctcaccaccgcctccaacgccaggagagtccagaaggccggagggcgagggaggactgacgcgtgggcggtgacggcgcgggagccagtgatgtatttctgctttgggctttctcgcacgtggcacttggagcacatccttgggaacatgtctgtcctctttgccagtttaaatttttgtgtgttcgtttccatactagctcttagaatctaaatcaagtgttgtggatggtgtgcaagaccatggctgtgtatgtgtgtgtgggagtctcattgaccacagtgctgacacagtttcccttggtggaagtaaagagtaagttcaggactcccctgtaaatgatgtgctccccatggatgagggacaggaagaacatcagggtaccgtgccagcagagctctgtgccctgttagtcgaaacaaaagtgatggctgagatgagtccttctgtggcacccaggaaactttgatagctgggccaagaagcagcggcactgcagtgccctgggccgcgagcatcatggtttatgctcagcaaagccacatcacctgtcatatagacctgacatcagctttacagttttgcttgcatataacttgcaaattttgttttgtgttttatagcctaagaaccattaaaataaggaaacagattttatatagagacatttagcagtctaataaaaaaaaataaaaatcacatattgtatgatgccatttatataaaatgtccagaataggcacatccgtagatagaaagtagattagtggctgccaggggttaagaggggagaagtgagggagagactgttcatgggcgtggggtttctttctggagtaatgaaaatcctctagaatctgatagtggtgatggtgactgctgtgatatactaaaaactactgaactgcgctgtttcaaagggcacattttatgatatattttatctcagtctttaaaaaaaaatctcaacactgggaatccataagaaaactttttttaatttaaaatgggtctgtcaggcagggcgtggtggctcacgcctgtaatcccagcactctgggaagccaaggcgggtggatcacctgaggtcaggagtttgagaccagcctggccaacatggtgaaaccccgtctctactaaaatattagccaggtgtggtggcagtcacctgtaatcccagctactcaggaggctgaggcaggagaatcgcttgaacctgggaggcggaggttgcagtgagccgagatcgtgccattgcactccagcctgggcaacaagagtgaaactgtctcaaaaaaaattaaaataaataaataaataaaatgggtctgtgcattaagcagctgtagttcagagattgacaaagtttgcggaagatgagatgataaatatgtttggctcagaggaacatagtgtccctgctgcgaccactcagctctgccgtgatagcgcaaaagcagccacacggtgaccaggttgccctccctgcaggcctgctaagaggactctggctagattccagcccttgctggtccccctggcgttggggcaggggggaggcgggcagcatccctactgtcccaccggacccagcagccacaggggcctttcgcttctccacattccttcctgccctgccctaaagcaggaagcaagacaaggaaacctctgagtcaggtatgtggatgtcctctgcagaactcgcctggtcccttccttcaagtcatttgtttctttctgtgagtcagccctgcctcctgtttaccaggcacaggtagttttacctgtggctccctgagcagaactggagccggtgtaacacaggctgtgtctctgaatagaaagtctccacactgccgtgccgctctccactctgtgtttgcccactgtatgcaccagagcaccctcccggctccccttctcctaagcaaatcccacacacctgcatcccatccttcctcagatcacttccggaatcatctgcagagtttgggtttcatggtttgtgcgacactctcaagcagctcacccaaatcgggtggtgtcagatggtaaagggttgaggggtctaggtcagggtcacttggaaacaagttcctgggggagcagagcaactttcttctctacttggaagaatatgataaagcacccctagactcactggtttcgagttctagggaagcagatattgatgactcaacagaggaaaggattgtgtaatcattgctttagtcaggggttagcaaactatggtccacaggccaactctggccccctgtctgtttttttaaataaagttttattggcatgcagccacatccgtttgctcacaggcggcctgtggctgctccctctctataatggcagagagttgagtcattgcaacagatcggatggctcctagggctgaaaatatctgccatctggtcctttacacaaaggtttgcttgccgaccatgttgggcttagtggaggggtgtaagggatggtcttacatgagtgtgcttccagcacagggagcatggaacccagtggcagtctgtctggatgttttcaaagaggcttctttgtaatagttcgcgattatcttgcaacatgatatccatctccccatccctagtgtggttaacttggggaagtttgctttgtccaagtagagggggctgtagcttgttcacagcccaagaatgcaggagcacgcaggatgctggagcaccagcttttctgacttgttagtgatagcctgggttagggaaggttgtccttggaccacatgggctgggcatgcccctcaattcatggaaagtgactcagaaaagttcaaggtttcaccaagactaagaggtgaggaggaagttctttcagaacataagggtactagggtggtgatttcattctgttctttttttatgtgtggactttttcaagggcacaaatgttttgtgtcaattaaaagcagatttgtatgcattttgttacaatgattatgattttaaagtcttaatagtattatactatacaatctacaaaaagatttgagcatcttataagccctgataattatgcctcgctctaagaaacatgggtatctggaaagccacattataaactttaatattataaatgtgctttctgtttagaaggaattcttggagggtctcctttaagagtggattcctaggccaggcacaggggctcatgcctataatcccagcactttgggaggctgagaggattgcttgagcccaggagttcaataccagcctgggcaacatagtgagaccccatctctacaaaaaaaatttagctgggcatggtggtgcacctgtagtcccagttatttgggaggctggattgggaggatcgcttgagcctgggaggtcaaggctgcagtgagctatgatggtgccactgcacttcagcctgggtgacagtgagaccctctctcaaaaataaataaataaataaataaataaataaaaacaaaaataaaaaaacaggattcctagagcacagccagcatgcagaacttgttttctaaggcttttctccaataaaaggaaccagggctcctcagaggaatgactgagtctagggttggggcagggactgtacaagatgagcctggagtatcttatagtgccagaaaataagcgctcaaatacacccatatgtaaacccagcggtgacaacagtgtgggtatgtcatagggacacaggaaccaacaatgaccaaaggcagaacaagttaagcagcaaaattaagtagtagtggattataatccaatatataaaatgaatccacagcccagactgatacgcaggatggttgaataaattaacaaatgaagaatagagaaatctgctgtgcagaaaattgcaaatactttatgtagctactgtgcccttaaggaggtggagcatagctcccccgctccccgctcagtgtgggctgccaacagtaagctccctccaaagagtacagtgtggcaaaggggaccgaggagaggaacatcacagtggagaaactggtgtataccaacttcaccaggcgatcagggccaacgttgacaggtaagtcacattgacagcatgccccttgatatcataggataacagtggcacttcacttccatggtctctctcccagaagtcccaggctaatcataaaaacacatcagacagttcccaattgagagacatgctgcaaaatgccggaacagacctcttcaaaactattaaggtcatcaaaaacaaggaaagcctgagaaactatcatagcctattcaggctgctataataaaacacctaagattatatgatttataaacagcagaaatgtatttgtcacagttctggaggctgggaagtctaagatcgaggcactggcagattcggtgtctggtgaaggtgctttctggctcacaaatggctgtctctctgctgcgtcctcacatgatggaaggggagagggagctctcaggggtcccttttatgagggcactaatcccattcgcaagagctccatccttatgacctcatcacctcccagaggccccacctcctaacaccatcacctgggggttaggtttcaacataggaatttgggggtggggggcacaagtgttcagtctaaagctatagcaccctcacagcaagaggagtctgaagaagcaggcctgagtatgatgcagtacctggatgaggttcaaagacagaaggagaacattgattaaacagaaaatttgaataaagtgtgacctttagttaatattaatgtaccaatattgattcattaactatgacaaacacaccccatagtaagtcagatattaataatagggggaagtgggtagagggcatatgggagctctcgcctggctgttgcaattttttagtaaatctaaacccattctaaaatgagatgctggccaggcgcaatgggtcatgcttgtaatccaagcactttgggaggttgaggcaggaggattgcttgaagccaggagtttgagaccagcctgggcaacatagcaagaccctggccaggtgcagtggctcacgcctgtaatcccagcactttgggaggctgaggcgggcgtatcacttgaggtcaggagttcgagaccagcctgaccaacatggtgaaaccccgtctctaataaaaatacaaaaattagctgggcatggtggcgtgcacctgtaatctcagctactcgggaggctgaggcaggtgaattgcttgaacccaggaggcggaggttgcagtgagctgagatggtgccactgcgcttttgcctgggtgacagagtgagactccatctcaaaaaaaaaaaagtataatgaaatatttattttttacaaatttttatgtagagaccaggtcttgccatgttgcccaggctggtctccaactcctgggctcaagcagtcctcccgcctcggcctcccaaaagtgctggggttataggcgtgaaccaccacacccagccctataataaaatatttaatcagccatcagctgattgctgttccgtgtgtggcctggcagtatgtgttgagcatttgagaaaaggtgatggcccggggtgaatggcaccctctcttagagacagtaacatgtacttggtaaagtaatacgtgaagatgaaaagtactggaaagaacacgggcttcggagttgaagacacaggctggaatcctcattctgcctctcagtgtaagtgtgtcaggtcccccaagcttgctgacctcacggccctggatcatggggatatgcagagcaaccttgctcgcagacttatttacatgcttaagggatataacattaatgaatcagcacagtgcctaaggttaagtgtcgatatgggggaaaaaaatctaaaatagcagtgatacagtataggctgcaaagcagcatatgttatttggagaaatgagcaagagttggaagtaattgctatgaatgtagaagagggtgacaggaacaggttggaaagagaaactccgtcctggtggctaagcccaggatgtgggagggtgggatagggctgtgaggcgcagtggctggcgacgctgcttcctggaggggctgtggtgctgaggtctggggctgcgttaggagggaggtggggctcagggactttaaatagagatcattgtgaaatggttaattgggaaagtcaggtccagcctgcctttgtcttccctgagtgccttgcacacactcaaagttccggaaacgcttgttagttgcttgatgggttacattcctaatgagtgtgtaatcaacccaagaatatatggacatagaataggctgttgaatgttttctttttcctccttatggttgtggagttgaactgtgtgtcacatatgttataggattatctagcatcacttaatagagaaagctgtaacatcagtgcagtgggctttctatatttccccgttaaaatataagaagtgctgggcacagtggctcacacctataatcccagcactttgggaggctgaggcaggaagatcacttgagcccaggagttggaggctacagtgagccatgatcataccactgcactccagcctgggagacagagcaagatcctttctccaaacacacacacacacacacacacacacacacacacacacacacacataaaggaagactgccccccaagccttttggggttttaaattacaagacacacacacacacacacacacacacacacacacacacacacacacacacacataaaggaagactgccccccaagccttttggggttttaaattacaagacttttggggtttaagcactgaagtgttgggaatgttccccactgaggcaaggagttgctgatgaagtgatgggaaatgcaagcggagccttgagccgtggaggtgaaggttgacggagcctgcgtgagcttgcccatcaacaagacagcaggcacagacaggccagctgttgtgagcttggctttaggactccattcagtaggcaggaggagagctgcagcagaggcgggctgtgggtccctgaagcacatcgctgccttcacagctgggcgaactcccatccagcacggtaagcagagccgggtaagggacctctgcgtttgctctcggggcacttcatcccagatgggaccggtttcaggacgcctgcgccgtttgttaggggtttgtagttcccagtggctcttttgttctgctatcttgaagggcaggttgcttgtcagctcacaatgctgtgggtaaggtctggtgaggtcggcgaatgtgttctcattgtttattcttctgcctgaagatgagaaataatgcaaatcagggtgcagattccggctcgagctccacaggcgtgcacgtatgtgtaagggcatgctcgccggtgctgcatgtcctcgtggatgcatgcaatttttacagctttgggattcacggttagctgaaagcacattggaactggaaggcggtgctcttaacaccgtgttctaggctggaagccgtagagccatcatctgctctgatgggactgcagcccttggtatgtgggacccttgctccatgtgagttctgcagatgggttccccgagggagctggctggaggacgccagcatcgcatgaagacctgcctgcctcgtttgccttttgtttttcagtagcagtaagaaacaggcattctcactacacaggcattgaatgcggacattgagaaaaaatggtgagtcagctacatcctcaagaaaaaaaagcggcgaaatcaggtgtgcatgtttagtcatgagaaatgttccctgagtgcgtttgcacatagcctgctgattgcagtgagataatttaaatagagaaaatggaatcaccatggttcttagcattttccagttcttttattttgctctttggtgtgattgtgacagtttaagggttttactatacatgtgctttttcccccattttatgttgtgataaaagaaagagatgattagttttggctatatttctaaatggttggaatgcctttgctttactaaaggaggcttttgtgtgtgcagagggtcgatggcattttcacagggaaattgatgcataaatatgtttgcacacacaggctgtctctttggtctgcatttactgactcacaagagtaggtgtcattttgaaatgcatgtttttagcggttgtgctagttgaaaggtaaaaaggcaaaggagtttgaagaaaggtttttggaaatctacctggtagcacttacgagtaaacagcctactgcctcgtagatggtcttaagatttataagatgaatggaaaataatattttaatgtatcatataaaaaaactgaagatttggtaccaagttgatgaatggttggcatatttcttttcattacggaatagaacctttgaggtcatactctacaagtatttcttattattttattgcggaaaagcattgcatgggtggtagaggcacatttctttcttttgtcacacatagtggcaaaaacattttatactttgtccctttctgtttctccgcctccacctgcgcccacccccctgcccccccgcccctcccgccccgatcaccaccaacccaaaccaacaccatacctcttaaggaaaaaaattgcaggggaattctcatctacagaggcatgaacaacacacacagagttttttacagagtgctaggaataaccatacacgttggtgtcaagcatataggctgcggaaggctctattgcccagccagagggacaaatgaccctggtgaatgcacgctgactgctgcttgttttgcatgggctggctgctcttccagagtccgcctttggattttggaggttgaggaaggaagggaatattttatgtggcctttggaatacatttactttacactacctttaattttttacctctcatatgcattaaatttttaagaagaccagggtaggggagcagtgggaagaagctgatgtcttgtatccacccatctttcccctgtcctcgggcactgatttccagctggcttttcctagagcaagtaagacagtcgggtcatttctggaaggcttgtagacatccttggatgtctgaagaggtcctagagttatttacttatttacctttaaaacatatttgccgacaccttatttaaaattcctgaaagttcacagtgcctcttcatatgtataccttgggtcctactatgcggttaccatcttgattttataataaagcaaactgggggcggggtgactagattctcacaaccagttagtgaagagccctcgtggggcagcatggctgattttcagtctggtgggctcctgcggactaatgggtcgaggtcctccaggtaaggctgaatgtagaactggcccaagaattcctagttattctcttagtaactttcacatcccttatccagtttgctgccagtgcagtgagaaggaatttcagtttggacttctgggagtgaagtacagaaacccgttaatcaggcagagacagcatgtgtgctcctcagcctgcgttggtgtggcttgcgaagccacctaagcattctgaccctccatttcttcatccataaaacaaggaacacagattaaattatttcttatttaaaaattatttattttttatgtttaccattaccttgatcttgaagtttaaattatttcccaggtcccttccagctgtagtcatttttggttcttagggagagaagccagggactcaaatttcccttcagtcatatttccagctctgtggggtgatttgtggctgcactgttttgctcatttgccgtcattatttccaggaacaaaagcatatgaatatatatgagacacacgcacaggggtaatagcttcgatatccatttacaaataaaatcagctctgtcagcaaactcaattttctgtcaacagggctttgttgatgggaatgcccttgacagctaagcctacttcggtcttcttgtggtaatgcctcataaagccactcactgccaaggtgctcttgggtataacttgcatgaaatttgttataaaattattccgttaaaaaaatctagctggcggacccttaaatgtacttggaggccattaagggtggaaaagctagaaattctaggaaaattttcaacatttatacacgtgtgtgtgtatacacatatacatgcccatacacatatgtgtactacacacattttctatagtaattatgcatataaagttaatgtcatgtacaacaaatatctgaagtctattggataaacaatccatttccgattctggttcagctgagttagaagataggcaggcaatgatctgagatggaaggtttccacagtttggggtcacgtgcaattgtgatagaaggaagattgagattttctcttaatttatgaagctgatatgctattctaactagtttttaatatatcttaccacagggccacccaaaattcaaaattactcctgattttgtaagcttcacatatgtttttgagaatgaggttttatactaatctgggattacagctttctaggctgtgatatacagtttttattaacatttcctattttaaaaatcaattttgctaattaaaacctttttattaagaatatatagaagttctgggaagcagagtgaggatattaacaaatcaccctcaatcctatcacccagagtctccgctgtggaacatggaagtatatctgctttgaagtccttgcaaatatgtttttacacatgcaattatattacacatactgtatgtaagctgcctttttctgtaacttgtatgtgtatggtgcatgacattctaaaatctaacaaccctgtagccatactgtggacatttagggctgctgttggtgtttgacgttgtaaataatactgcagcagatatctgtagtgaaatacttgtgctcttccatgttgatttccttcggataaaattctgggcatggagttgctaggcaggcgctagaaaatatcaccacgttgccctccaaaaagtgtatgcttactatttacactctaggggcaccgatcgcccaggacagtcctacttctcccaaaactttgtcaatattagacatttttaaaattctgtggtttgataggcaaaaaagttatttcatttttaacttgcatttcttcagggactagcaaagtcagacttttttggtgcactgactagccatttgtgttttttcttttgtacattactcttcagcgcgtgttcattttcctactgaagatgagccctttcttgattattgtcatttaggttgcagataacatccctaccgtgtgctgtgtgccttccagatgttagtgggtggttacagttcaacttttttgacatacaagtgtgttgaattttagcgttgtcgcccttgcacctggagcctctgtgtggccagttctgccttttggtggctactggcttctgttagttgtacattgccattactggtctcttgttaccatgtgtgccgcagaaggtgtagccaccaggagctctgtcagcatgaattccctaggaggtgtagacatccatctcggaaggctggtagaaaaattgtctctgtggaaaaattaagaagtgcccagctttccgacaaccctaactcatcgtagttcccatcttttgctctggttgacaggaaactcgtggtcctattggaagcacaaccataggacctctgtacattctcgtgtccggtctgctctttgcataagggtgcttgcccctgcttgtgcccttctgctttttgtttacatttgctctcactgtgatgtttttatgttcattttgatactcaagttgtgtgtttgttctcctgcgtgagacacttctaaacatttcatcatttagggtatacatagatcaaagtaagtggggaccacataaacatatgtagaaacacgttctgaacaccaaagagcttctcggtcaccagttaatattgtggttctttgttgttgttgttgttgttgttgttgttgttttttgagatggagtctcgctctgtcacccaggctggagtgcagtgccgcaatctcagctcactgcaacctctgcctcctgggttcagccagttctcctgccttagcctcccaagtagctgggattacaagcatgcgccaccacgcccagctaatttttttttgtatttttagtagagacagggtgtcaccatattggccaggctggtctcgaactcctgaccttgtgatccacctgccttggcctcccaaagtgctgggattacaggcgtgagccaccacacctggccaatattgttattacagtcactgttttatggaaaaacttagtgacctcatatcgttcttactgggcaagtgagcctaacacaatctgtttctatagtaattgtggaaatgtgacgttacagtggaagaggagagttgggacatggctgtggagtggagctggggctgtccacctctcacttagtatggaatcctctcctaggcccttcagctccagcacactggaagtctaaggggttttgtttgtctgtttgcccctatgttttaatcaccgctaggatcagaagaactgcagtctctgtgaacaggtcttcaggtgacatcagtgtgttacctccctggttagcaattagcattcccgaggtcgggtgctgtgctgcatgcaaagttgaatcaggcacagacagaaccttccttgaaggagtttgtcctctcttaatagtgaagataatatagaaattgtcctagccagtttacactcctaaaacaaattaccatagactaggaggcttaaacaacagacttttattgctcacagttcttctggaggctggtagtccaacgtcaaggtgctggcctgtggattcctggttcacagatggcactttctacctgtgtcctcacatgagggagagcagagagaggaagcaagctccctcgcatatcttttctttttttgagacagggtctggttctgtcactccaggctagagtgcagtggtgcaatcacagctcactgcagcctcaaactcccaaactcctaggctcaagcaatcttcccacctcagcctcctgagtaactgggactttaggcatgtaccaccatgcctggctaattttgtttgtttttgtagagatggagtctcattatgttggccaggagggtctcaaactccgggcctcaagcagtcctcccaccttggcctcccaaagtgctgggattacacgcttcagccacaatgctatccttgagtgcttcttatgagggtactcatccattcctgagggcttcaccctcctgactgcatcaccttccaaaggctccacctcttcatcctatcccattggggttaggatttcaacttatggatttgggaggcagggcacaggcatttagactgcaacataaatgtgaatggctgaggagcatgggattcagaaggcccgagcacatcaggctgcctgctttgctttctgctcctttcttctctcttccctcctcccttcctttgtttctttgttccttctttcctgttgactcagtgagcttttgctgcaatctgctttgtgccaggcattgtgttggacctggaatacagaggtagatgaggcaggggtgagcacagtcgtttcagctaggaggagagatactaaatgaaaataccacagaatggtgaagtgcagtctaggaatcaacaggtagagattcagtactgtgcaagttcagagaagaaaggcatatctgtgtcaatgggtccaggaaatgtttcatggaggaggttgcttttttttttttttttttttttttttgagatgaagtcttgctctgttgccagtctggagtgcagtggcatgatatcagctcactgcaacctctgcctcctgggttcaagtgattctcctgccttagcctcctgagtagctgggactacaggcgcccaccaccatgcccagctaatttttctatttttagtagagacagggtttcaccatgttgggcaggatggtcttgatctcctgacctcgtgatctgcccccctcagcctcccaaactgctgggattacaggcgtgaaccaccgcacccggccccgcatttcactggatcttcagaacaggaatggcttccttggggagggtcccaaaaagtgcgaatcaaaacagagatttgggaaccaccaggcatgcataggtagggcagggcatctcaactcactgcaacccatcagagagtacatctcaacccactacagctcatcagacagtacatcttaactcactacaactcatcagactgacatctcaaatcactacagctcatcacagagtacaactcaactcagtacaactcatcagacagacatctcaaatcactacagctcatcagacagacaaatcactacagctcatcagacagacatctcaactcactataactcagacatctcaaatcactacaactcatcagacatctcaactcactataactcagacagacatctcaactcactacaactcatcagacatctcaacttcactacggttcatcagacagacatctcaaatcactacaactcatcagacatctcaactcgctacaactcatcagacagacatctcaaatcactacagctcctcagacagtatatctcaactcaccacaactcatcagacagacatctcagctcactacaactcatcagacagtacctctcaagtcactgagttttatggtctgtgactgataccccgatagagttgtggaggtgaaaagaatacaggtgaaagtgtttggtaatatgaacacctcctagatccatcctagatgtctagaaattcacatacacatttgtggctcagaagagcatgtaggtgtagggaacaaggtgtaaggtaaactcaaattcatacattgcttgttacctctgcccagaccttagtagctttaagcttttgtcaataatagatcatacctaataaatattacacaacccagatgcttctaaaactattattgaggtaaatgaaaatgtctgccacagtaagatagtatttatcacagagattcagatatgattttttttctcttttaacctaaagaaatatagtaataacaaaaaagtcagctaatatgctataagcaattgttgggaatcttggcatgaaatccagttagggtactgattgtgcccatatcagatttttagaagcagataacctgatgtgtttatgagttttatttctggtctgctttctcctcaaaatttcctgtgtatacattgaaaacaaaaagccagccacagatcacttgatcattatagcataaagagtagaataattgtgttagttaccttgctgcataacaaatcgtccaccaatttggtggcttgaacaccactaaacatttattatctcatacactttctgagggttagggaggagattagctgggttattgtggctcagcatctcctgagattgcagtcaacacgtgggccaggacagccgtcttccaaaggcttgcttggagctagaggatccgcttccaagagggcacccatatgtctgttggcaggaggcctcagttcctccccacatggatctccgtatagggctgcttgagtgtcctcacaacatggttgttggcttccccgctgtgagttatcctcgggagagaggaaggaggaagttgcaatgcctgtgtgatctggtctcagaagtcacacatcggcacttctgccatacatttttaaaccaatttattgaggtataattgacatataaaaggctgtacatatttaatgtatacaacttgatgaatttggagataagtatctataagcctgtgaaatcatcaccacaatcagtgccttaaacggatccatcacctccaaaagttttctcccaccctgtcaaccctctttttttttgttgtcattgataagatctacccccttagcaaatttgtaaatgtacaatacagaattattaactacagacgctgcgctgtgcagtaggtctctgggtaattcatcttgcgtaattgaaactttgtgccctctcaccaatacctccctgtttccccttcccccatcccctaacaaccaccattcattctatttgaaagtttaaaattcttcacgtaagtgggaccatgtagcacttgtctttctgtgcctggcttgtctcacttagcataatgtcctgtaggctcatccatgttgtcacaaatggcaagatttccctcctttttaagtcttttctattcctctatatgcacgcatcacattttctttattcactcatctgtcaatgtctgcttaggtggcttccatgccttggcattcacaatataaatagttcacacaagtgaactattcacaatagttcatgtcgtagtaaacatgtgagttctgccatattttgcttgttcaaaaggagtcagagtccggcctacttctaacaagctccacttgtttgaaggaaggagtttcaaaggaattgttggaacttctttgtttgtttgttttttagaaatgagttctctgtctgttgcccaggctggcatgcagtgacatagtcatggctcagtgcatcgttgaattcctggattcaagtgatcctcctgcctcagctttccaagtagctgggactacaggtgcatgccaccatacttggataatttttttaaaaacttttctttcggtaccagatcttgctatgttgcccaggctggtctcaaactcctggcctcaagtgaccctcctgcctaggcaacccaagttgctgggactccaggcatgagccactgtgcctggctgattttgataactttatacacctcgtaatcaaaacagtaagttccagaaagctcctttgtactctttccaatgaaaccctgccccacaaccatccctccctgatgtgtgaccctagtgagtgttgcctcttcttgagcttcatgtaaactggaccctacttgtgcgttctttggcggttgacccttcattcagggtcgtgcccctgggacccattctcactgctgtgtctcggtagtttttctaaattactggctagtgttcccttctgtgaatacagcaccactggttgatccactcaccagtaggtgggcagtgtttggccaacatgaatgagggcttgtgttgtttctcttgggtgagagagttgtttctctgggagcggtggactggctgggtcgcagggcaggtgtgtgagagtctccttcctcacacagtttcactaggactcagaagccatggtcttttctctcctgtgaagggcttgagactttctggaattgagttcatgtagctgtcctcagcttttgatgagggacgtgtgtgtgttccaataacacttcgtttacaaaaccaggaggcagtggagagttggcccttggtttctagtttgcaaactcctggtctagaaggtaagacaaatattaatttttaaaacccgcgtgtctgtaattgctcattttgaaagcactgtgaagggaacactaagggagaggggatgggaagactttttacatgtgtgtggggagtctgatgaatttgtaaaacctatgattttataacttttctggcctctttttagttgctactgtgagcagtagtccatatgtgaaccagagtggacctccacaagctgccttttgaagttgttacagttagcagagacgaactggcccagggttcaagaagcctttctggctggaggaatgtggatcagtccctccaggcctggaagagggcagtggggggcggggggtgcactcaatcttaccattttcacagatgagagtaatttcatttcagaggggtatgccaaggcagcgatgaaaacttcaggaatagctttgaatatctaaaggaagtgggtaagaaagtgggaggttgggagttccggagggagagttcctgtaaagcagagattcccagggctggctcaacatccacattgcctggagggctttccctgaaacacaggcttgcaggcatgccagcccttgctatttcccacctctgcccaggcctggccctcatcaaggcgggagagcccagctcccagggctcacgctctggaaccaagaatgtggctctccaggcacagagacaatagaggcctggaacagatcctcaaaatgtgtgtgctgaagacatactcagggtccgatacttgagggccatctcacattatcatctccaaatctaggcaggttctgttattgggcattaacccctcgagaaatcagtgcctgtaactatgatttggatcatctgtgctttggatttctcttttaatcttctctgtctcctcccattcttaaccacaagtgatttatcagcctctctaattcaacttcattactctttgccatccaagtccctgcaagcacaaataaaacccaaaggaagcagcagacctttttatccatctgtgaagacactcaagaaacactaaattcatctgactttctagagtaattgctttccccacatggcactagaatcctggcatacagggagcagcttcagcagagacacggcagtagagaaatgactgactgaaggatggttcagggctgttgtcctccctgaaggtggttccaacaggacacaaaagttgcagcagagcctgtgagaacagctgtgtcctttgtcgtcactagctggtctgtctgttcattgggcaatttcagtttttatgactgaaagctgggcatgcaaaggacaaccaaacagcctctagcctgctgatgctcacagtctggaaagtcctatggtaaatcaatatttcttttttgcttttcagagacagtctcactctgttacccaggcaagagtgcagtggcatgatcatcgctcactgcagcctccaactcctgggctcaagcaatcctcccgcttcagcctcctgagtagctgggactaaaggtgcccaccaccatgcctggctggtttttcaattttttgtagagacagggtcttgctatgttgcccaggctggtctctaactccttgcctcgggcagtcctcctgccttggcctccctaagtgttgggattgcaggcacggggcaccacatccaggcttttttcatttgtttttagagacagggtctccctctgtcacccaggctggagtgcagtggtgtgatcatggctcactgcaaccttgaactcccagggtcaagcaattctctcacctcagcctcctgagtagttgggactgcaggcatgcatcaccatacctggctaatttttaattttttttttatttttattttttgtagagactgggtcttgctatgttgttcagagtggtcttgaattcctcccacctcggcctcccacagcactgggattataggtgtgagccactgtgctcagcctggtaaattggtatgtctaaggagagtgtttggtgccattgttcccaggtgttcacactgtttaaaatgtttctaatacatctcagcattgataggttggttgcttggttggtttcttgcctcttttgggctccatcgccttccccactgtctcctttttccacctcatctggcctttgtggagtgctgtgttggcaaaagagctttccacctgtgcctccccaagggtgtgtgtctgtaagagctgcccagggcctgggaaggacagtggagacaccaggtactcgttcgggagacttgtgctcaaaatgacatgggtgtgccggctcttagctgcctgacccgcattctgaggcctggtggcgccgtgcttcttcagcgtgtgaacacctgcctggcagcgtctgatacacctcaccaggctgaagggcagaccagctacctgtgattcctgataaaaattctgtgctttacagaatcccttctatttatgcccacaaccaatggaggagtgctttctagatgataacctcaaactgtcagtgttgagcttgagttgatgtttgagttactgagcgttccacgttccatgctcatggaaacctggctctgtttggaagcagcaatgctgggccctaccccagttgtcccatgagataattgtgctctgtgcacacagttccggtcccagaccctggctttgtagcatacattttcaaggaggactcttgggccaccacagatactgccctatccattgctatttttgatggtatgcttgtgtataatacgtttgtatatggcataagttagcagaatatgtaaatgaaaggaggaaacacctcaatgtcattatccacgggaagtgtgttcactctgtctcttcattgtaaaaatgaggcagtgccgttgcccagagctctcttggcaccttttatacccctcaccggctggcttggtcggctgcaggggtgcccttcccatctcattggctgggtgtgttgcatggtgttatgctttgggaagaaggttgtatggtgctggtgtcacagaggcctgtgtccaggtctgccccatcacagactgaccctttggtcttaggtgctcagcaggtgcctggctcataggaagcccacgcaactccatctcccacaccagggcctttatctgctgctagctcaccgccatcctatgcgatgtggcctgtgatcagcttgtacaggagaggcagctttctggggtgtagttgcctgcctgacgtcacatagctggcacgtgatggatcccgattggatgtgtctgcccggggaaacctcaagtcacaggcagctagcacagctcaagcgtccctaatcagaaggtctgaaatcttaaatgcttcaaagttcaaaactttttgagcaccaacatgatgccataaaggaaaaattccacagctgatctcgtgggatgtgtcgcagtgagaatgcaggtagagactgggcaagctgctgctgtttgctgttgctggcgcctcacagctgaggcgggtgttctggtgccattgccgtgctgcttacttaccctggacacattcctctctcactgtattgatggtatatcgtgcttttcactgttgagtgcttatatatcagtataggaaaattattgcttgttggcagcatataaattcagagtccggaatgacggagatgccagacaactacagattgtgcacatgggtggcagagagactgacacttttgctttatgatggttcggtggatacaaactttgtttcgtgcacaaaattattaagcatattgtataaaattaccttcaggctatctatataaagtgtatatgaagcaaaatgagtgtcaggtttagacttgagtcccacccccgagatgtctcattatgtatgtgtaaatattccaaaatccaaaaacgtctgaaatccaaaacacttctggtcccaagcatttcggaagagagatgtttaacccgtactttagaaagcactcaggcgctggagttcatcgcgggcagcatttcagcagcacctgtgttgtgtgtctgcaaatcagaatgcatccctatcccatcattgacaccaaaagtagttatgatgcctgtggcagtggctcatgcctgtactcccagcactttgggaggccaaggcaaaaggatcacttgagcccaggagtttgaggccagcatgggcaacatggtgaaccccatctctacaaaataatttaaaaactagccaggccatagtggcatacacctgtggtcccagctagtcaggagactaaggcaggagggtcacttgagcctgggaggtcgagactacagtgacccgtgatcacgctgctgcactccagcctgggcaaaacagcaagaccctatctctgtctccaaaaaaaaaaaaaaaaaaaaaaaaaaaaaaaaagtaggtgaggaggaccctgtggtgtgtgttccttaagtcatctgcaagattcagaaattttcccatcctccttgctaaagataattgttaaccctattcagaaaacagtggtggattattgattacagagcagttcaaaactgtttagttgtgttgggaacattcacacacaaggtcctttcacggagaacttaaccatggtgtcttgaaaaaatgcagcttctcaccttttaaaattccgcacaaaaaaagtgaaagtgattgaaagcaacaggtgcatttacattgtgttcaagtgagggcataacatgatgcatgtaataaatatttgcttgcaaggccctgaaggaaatagcccagatccctgccctctgtagaggtgctttcagcccagggaggagcgtggaggcaggtgagcaatgggatgatttgagagagtccccttgctggggcgtgacctggaggtggggtgatgtcagggcaggactgggggagctgagggctgtgtggaggcaggggcagtgcaaggagaccttgcattcagacatggggctggctgtctcgtcgtggaagcaaaaatagagtaatgccagcaggatctctagagtgtttgtttttttcctaacagtggtttcggtcctgtcatagcatgctgggtgactgagtacactaatggtggcccttcctgcaggtttgtccccttcatataagttctgtttggctttgaggtgctgttttagagcttcatgctctgtctccttcagtggcggccagcccagggagaatggcagggccgtgggctccatgtagcagatctctgaagccactgctgcttggagcctgccggccctctcccctctgggaactgtgcaagcagctgtctccttgggaacgtggcattagcatgttttgcatgagaatgaacaccaaccaaggctgaatatcaattggatcctagagtgcagctgcctttgaaatgttcctttgtgtggccgaacttcctgctgcagttgattcctggagcttgtgcgaagacacaaagtcttaagtcatcttagtgccttgcttactctatctctggatcttgctgtcaccatttattttatccttagaagtatggcaaagagaaatgcatacatatatgcagagacacatgtctacacacaggcacaacagagacacacgtacctacacatgcacacaacatatacaacccgggcacacactcacaacatgcatctccacacagacacaacacaggcacacatacccacacacgcatacaacgcacaacacaggcacacacatacaacacacatggacacagagacatgcatctacacacatacacaacccaggcgtacacatacaacatacatctacacacagacacatgtgtacattcagacacaacccagactcctacatctacacatgcaaacaaccagacatacacatacaacgtacatctatgcagagatatacatctacacacatacacagcgcaggcacacacacagtgtacatatagacagacagacatttatacacatacaacatgcatctacacacacaaaacatagacacagacaacatctacacatagatctgtacacatacacaccagatgcatacaacatatagacatgcacgtaacacatagacatgcatctgtgcgcaagcacaacatggaccactcacacacacaacctgcagagctgcctcttggaaccagttagaaacaaaagttggaatatgaccccagcaagtccccaatccccatttttggtccttttcttcgtttgtgttgttgaccctgatggcccagattcttatcaactgcgacaataaaaaccaattagtgattttatagtttgactttgcaaggtgggggtggggggcaaacttggtccagacattgctgtgctgctgcaggtctgaatgaagtgcagtgttgggctggagcgcgccccgtgctgcacttctggcgtgggaagtgacgatgcagcacacaccactcccctgagaacagagcacccagctcctgtagtttggccctctaggaagatgggaaggagcctgtgggcaccttctgattaggagagaagccaggagccagcctgccgtccactttctcagtgggtctcttgctccatgtcattgttcacttctcacagggcctttgctccctgcaggtgagttctctttcgtttatgggtggatctcggagcacttctgcagaaggcactttgcaaatagagttcctttttaatcagtgggtgaccaaaggcacttggattttagcaataaattataggtcatttaattatctgtttctgtgatgtggtgatgtgatatggtttggctgtgtccccacccaaatctcaacttgaattgtatttctgagaattcccacgtgttgtgggagggacccagggggaagtaattgaatcatggggcctggtctttcccctgctattcttgtgatagcaaataagtctcacaagacctgatgggtttatcaggggtttccgcttttgcttcctccgttttctcttgccactgccatgtaagaagtgcctttcacctcccgccatgattctgaggcctccccagccatgtggaactctaagtccaattaaacgtcactttgttcccagtttcaggtatgtctttatcagcagcgtgaaaacgaactaatacctggcgcttttaaataacaggtaccaggtgctttcaagtgggtctatgggtgatagatttcaggagttttcaaagggaaaaaaagtgcaagtgtacctcaactctttggcatgaaatgaattattgaacgctgaaatattgaggctgggcgcagtgactcacacctgtaatcccagcacttgggaggccaaggcaggtggatcccttgagtccaggagtttgagaccagcctgggcaacatggtgaaaccctatctctacaaaaatacaaaaattagctgggtgtggtggtgcacacctgtggtcccagctgctagggaggttgaggtgggaggatcatctgccaaggaagtggaggctgcagtgagcccagattgtgcactccagcctggacaacagagtaagaccctgtctcaaaaaaaaaaaaagaaaagaaagaaagaaagaaagaaagaaatatggaaatgaaatggaatattgaattctgaaccattgaatattgaaatgcaatgtgggggagacatctgacctgtgagagcgcttctcagaatgcaaatcagtttggcagtattttaatgtcattctgtgttttataaccagacaaatgtattgttctctaacccatgcatagctgtgttcaagttttgttttgttttgttttgtttttttgagacggagtcttgctttgtcacccaggctggagtgcagtggtatgatctcagctcactgcaacctccacctcccaggttcaagcaattctcgtgcctcagccttccgagtagctgggattacaggtacacgccaccatgcccggctaatttttgcatttttagtagagatggggcttcaccatgttggccaggctggtctcgaactcctgacctcaagtgatccacccgcctcggcctcccaaagtgctgggattacagatgtgagccactgtgcccagccattcaagttattttgataacacttcaagctaggagtttctgttagtgtctgtctgatgcacatgagaaatctgacttctttgagtggggttgctgttgtctgaagctgaggttgagctatttggttacagcttgttttctaagcctgtgctgtgtcttcagcctcctctaagctgagagcagaggaggctgccctcccaacactttgggaccagacctcccaacactttgggaggccgaggcaggtggatcgcttgaggacaggagttcaagaccagcctgaccaacatggtgaaaccccatctctactaaaaatacgaaaattagccgggcgtggtggcgcatgcctgtagatctagctactccgcaggcaggcaagaggatcacttgaacccaggagtttgagaccagcctgggcagcacagtgagaccccatctctactaaaattttaaaagttagccaggcatggtggtgggcacctatagtctcagctacttgggaagctgaggtggtaggattgcttgagtccaggagttcgaggctgcagcatgctatgatcacactgtactccagcctgggtgacaaagcgagaccccaactctttaaaagagcctttgttggtcttaattttcataatacaatactgattttcaaggttttattaaagaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcaccttgctttagctcaaggcgttggacttaaagtcagtactggggaataactgtgtggacagaaagtgaagcttcagtggtggttggatttttatctcactggggggctgctgtttcctgcagggaacaggggtagatgtgaataggtgatacatcttccccttcctccaagccagatgcatttatatctgcattacccacaggcatctgcagggtagaggtctgtttttttttgtcgttgttgttgttttaatgcagtcaatatttgtgattggaatcgagtttaacctaagcatgcgacctttaggtgaaattggtatttttcatggtgtccagtattttcttactcctttttttccagatttttttttaatgttagaaagctaagctggtatataccttttgttaaagcagaagaatactcattcacatttcatggtgctatcatcaggatttcaggcatggaattattgcgtccattgagatgctgatgaatgttaggcaggaacttgacctttcaagagcactaggcccagcatggtggctcacgcctgtaatcccagcacgtcgagagttcaaggcaggtggatcgcttgagctgaaggagttcgaggctagcccaggcaacatggcaaaaccttgtctctactaaaactacaaaaaattagccaggtgtggtggtgcatgcctatagtcccagcttcccagggaggaggctgaagtgggaggatcacctgagcctggaggtcgaggctgcagtaagccaggatggcaccactgcactccagcctgggtgacagagtgagaccctgtgcaaaaaagagcaccggctgtttagctttcttcacacacaaataccacctccttgagtgccttgaaggactgagaaatggaagaaggggagaatttctgtctcattctctggagcagtggctctcaacctaggaggtggagtgtgattttggcccccaggggacattaggcaatgtctggagacagtttttgttgtcctaagtgcgatgggagtggggggtgctctctgcatctagtggtggagcccagggaggccactcagggtctgcagtgtgtgggcggcccccacagagcattgtccgaccgcagatgccagctgctcttaggctgggaaccctgctgtagagccgcacgcccagcacaggacccaccatcacctgtgctgtgtaaatgtggggcaaagaaaaccaagtcgatgaatgcaggtcctcagtcacaccaggtgtggcgggtggctgccgtcctggacaggacagataacaggtattcccatcgccgcagaaaattctgtgggacctcactgctctagagtctcaagtaattttttttcttagcttctaaataactcagcagagaaagaacatgactgatactgatcctgtatctccagccgaggcattgtaaccacagttttctctgtgggccaaaactgggctttgcatcatttaaaatgtatctaaagatcattcagatatcccttgaattggtaacattgtaaggttctgaaaggaaagtgtcttactcctttcaggctgctataataagatctcatagactgcacggctcattaacaggagaaatgtgtgagttgatgagggctggtcgctggaaggtccgacccactgtgttctgtccttattttgaagtcaaggctcgtgaaactgttctcatgtggaagtcaagactgtttttaagaagagagaccatttctgttaaaaaatgatcaggaatagatgctttgttggaaagtgtatgtgaacccgtgggagataggagatttgttttttttccttcccggtactgtattttatattattatcattattattccctgtcgcccaggctggagtgcagtggtgcgatcttgacttttgggttcaagtgattctgctgcctcagcctcccgagtagctgggattacaggcacctgccaccacaccaggctgatttttgtatttttagtagagacggggtttcaccatgttggccaggctggtctcaaactcctgacctcaggtgatctgtctgcttcagcctcccaaagagctgggattacaggggcaagccactgggcccagcctctttcccaatattttaaaacctgtgaagggagatttgtttatgttgtttaatttgtttctattgtgcacatcaaatttctgcacaaaagggggaggataccaatacaggctgatgtgaaagtcagtaataggcaagcagagcttctcccgggagccgggggggcgggggtgaagggagtgcagagggttctgcgtttgctggtgcttggataaggtggccaggttttcctccttcttttattattattattattattattatttattattattatgtttttaacagagaggtggggaggtctcactgtgttacctaggctggtctcaaactcctgggcgcaagcagtcctcccaccttagcctcccacagtgctgggattccaggtgtgagccactgtgcctagccagggttttccttcataagtctgacctatctaaatggtattttccacagttagactttgtaaattgtcttcatgaggaagcagttgtgaggtgtctgtgagtccctagataaaacacatcagatgttgctgaaccctactggagagagggaggaaaatacgcagttagttcatctcagcctgagcaccactgccttgatagggaaagagccctcctgcattcccagtcaccagtgaaagagggaaaaacagcattaaatttagagcatcgtggctgccctcctgctgtggaaaattggatacatttgtgtaacatcgtaggggcagttttgggttgacttcattagaaacacatcctaatttggggttgtggagtttggcctgtttctttttgcttccctcctgaccaccagcatatggggctgcttctccagtgctctgaaaagctcttggctgagatggccctggtcagcatggtctagcacggtgccgctgagagcagcaggtgcagggctgccccagacaagggactgtggcattgctgggcctgttcctcctgttctctctcccccagtctcccagggatgctttaggtacctctctagtccctttcatccagaaacttttcttttttttttgagatggagtcttgctctgttgcccaggctagagtgcagtggtgtgatctcaggtcactgatctcagctcactgcaacttctgcttcccaggttcaagcgattctcatgcttcagcttcccgagtaggtgggattacaggtgcgcaccaccacacccggctaatttttgtatttttagtagagacagggtttctccatgttagccaggtgggtctcgaactcctgaccacaagtgatccacccgcctcggccttccaaagtgctgggattacaggcatgacccaccacatctggctgacacttttttaaaaaaaaagcaaaactgtgccctttggaagtaatacagaaccgatgactcgctgcttactgcgagatcgtatctcactggtgtgcaaatctgtgcaacgctagcttgaagcacagcgggcggggggtacaaggacagtgttgggtgggctgtcctgcatatggcacaggaggttctcccaagtggggtggtggggggctttggcctgactccaagcacggccactccggagaggagccctccccaggccctgagaactacgcaggaacccgcgggcctgcaccaacctaaggacggatgggaatcctggaaaatgcccatccactgcaggcttcccctacaaaagaacatttaacccaacagggcttgttgaagtttgcattatcatctgcggaatgacaaatggtattaaatagtcctcacagccctccacgaacccctggaggacaccttgggatgcctcaggggtggcattggcggtttgagcatagaaaggatgctgtggttggaaggcggaggtaggagtcagagggagcttcttgaggcctctgcctcatccaggatgtgggatcatggaggctccttcgagttgggtggctggctagtgcctttgagtcaggttcccatccagaggggagggcaggggacacgtcaatcagggtctgtggctggagcatgctttgcgatttcagcagactgttcatcttccagaattgagcgggtgatggacaacaacaccacggtgaagatggtgcccatcaagatcgtgcactcggagagccagccagagaaggagagccgccagagcctggcatgccccgccgagccacctgccctgccccacgggctggagaaagaccagatcaagacgctgagcacatctgagcagttctactcgcgcttctgtctgtacacgcggcagggtgctgagcccgaggccccacatagggcccagccggctgagccccagcccctgggcacccaggtgccccccgagaaagaccgctgcacctcccctccagggctcagctacatgaaggccaaagagaagactgtggaagacctgaagtcggaggagctggccagggagatcgtggggaaggataagtccctggccgacatcctggatcccagtgtgaagatcaaaaccactatggacttgatggaaggcatcttccccaaagacgagcacctcctggaagaagcccagcaacggaggaagctgctccccaaaatcccctctcctagaagcacagaggagaggtgagtaggcgtggcctcccagcttgggcgtgactctgcctggcatctcttaggcttgtaaagggaagggggtctgcctctctgttttcatgcgtgcttttggggaagacgggttttcataagggctcctcgatgcttagcactttttggcttttttgtgagcctccggaaagagaaatggagggttaacggctttgggcctgacatgaaaatacacactgcagaccaccaagctgccttggcctgaggccagcaggatttctgatgatgcccacaggtctcctttctcgtaagacagctgttctcagtgggggccgctgtctaccctgggggacagttggcaatgtcactgtggggaggggtgttccaagcatctggtgggtggagcccaggaacactgctcaacatctacagtgcacaggagggccccccccacagagagtcatccagcccccacgtgtccctagtgccaacatgagaatgaaggcttagattgaatatatatgtgtttctttatgaaatgtttttttaaaactttatttgaaatttttttacatctgcatttaaaaaatttattataatttggccaggcacagtggtgcacacctgtaatcccagcactttggctgaccgaggtaggcagatcatttaagcccatgaattcaataccagcctggacaacatggcaaaacccagtctctacaaaaagtacaaaaaattagccaggcgtggtggtagacacctgtagtcccagctactcgagaggctgaggtgggaggatcacttgagcccaggagttggaggctgcagtgagctatgatggtgccactgcactccagtgtgggtgacagagtaagaccccatctcttgaaatagaaatgaaaaaaaattacgacaatttacacctgcctgaacaaatgtattttaattggttttgtaagtagcactttcagcgtatctccttcagccacttgaccacaaaggcatgcgtggtggcatcttccctgctgctgacatatgttctgccagcacagcgtcattcatgggtaggaaggtggagtgggtatgacacacagccaaggaggagcagctggaccaagtggacccaggcaggagggcgccgacagggctgctgggaggaagggagaagggttggtgtttgtagatagcgtcacacatgtccttgtcctcatcaacccaggctcctggtagagatcatctgtgctctcacctctgtagcagagattcttagatattcctgcttatttgagtttttgccttttttaaaaactatgtttcatacacttacgagtatccatttgacagggttgatggtttttagttttaaccttgttacctacttacttttccccctttggctgtctcatctccctggctggtgtcctttcgtgagcaccagtgttgatttgtcacaacccagggggtggggcagaggggctgtttgcgtgcacagtcccagctcattgaagttcccacacctttacccaggaaagaggagcccagcgtgcctgcggccgtgtccctggccaccaattctacctactacagcacgtcggcccccaaggcggagctgctgatcaagatgaaggacctgcaggagcagcaggagcacgaagaggattcgggaagcgacttggaccacgacctgtcggtgaagaaggtaggagagtccattccaaatgacagcgtgtgcgtgtccaggcaggggcaggcatccggatcacaccatcctgccccagcgcagaccctgcaccacgtgtcccagggcgtttgtgttcagctttcactcaggacagtggaatttgaggtgatattagtgaagccctctgttgttagttctatgtcctaatcttgagccattccacaaacgtctctttgctgtttcaataggatccaatgtcaaattagtttagtcaccattctctttcattttatcttatttatttatttttgagacagggtcttgctctgtcgtgcaggcttgagtgcaatggtgcaatcatggcccaccgcagccttgacctcctggcctcaagcgatccccctgcctcagataaaggaaaattattttcaaattagaaagtggtaacttttttttgagatagagtctccctctgtcacccaggctggagtgcagtggcacactctcagctcactgcaacctctgcctcccgggttcaagcaattctcctacctcagcccctcgagtagctgggattacaggcacctgccaccaagccttgctaatttttgtatttttagtagagatggggtttcaccatgttggccaggccggtctcgaacctcaagtgatccacccaccgcagcctcccaaagtgctgggattacaggcgtgagccactgcttccgggctggaagatggtaactttttggttcaaggtattaaaaagggaaatgaaaattaagggtttaggtcttggggcttttacgggccctccatctggcacacggtaccattcgcttcattctggttgcacattcctcttttaaaaaataataaagaatccaaaacatgttcggtttttccacacagaaccaggaaaatcataccatctggaccatttgaatttgggtcacaccctaggtttagagaactgcattctttgctcgcatgcctttgtttttcatgatataatgaatttcagaagcggcatgccttgattctgccgccctcatctgtggggcactctgtccacctgctttgggaggctggagatgctgggaagccgcctcaccagaagtgtggctccggaactgagtgagtcactgtgggctggaagttggcctcactttagttcagcaagtgtgagttgggcacctgcaccagaagcacatgctgtacatcccagctctctatggtgctgatgactcagcggtcctgttttcctgcttgattggacaaagcggccactgctgcattacattttctccctgctttcccgcagccacacgcttatgatgtcgcacattcctgcaacgcgtgcacaggcggaggcgtgttcagggaggaagcgagcatagcgcagatggggacttagcaggccacctgctctgtagctgcttcaggggaacatatgagaccctaattccgtaggcttccaacattcccagggcgaccacagttgtctcagtcacagcattgctaggtggtcatagagctgagagccaaatcagggaaccctctgttttaggagaagactaaggacagagttgagagagtggaagccccaggcagggaggcagcagggggctctggtggctggtagagaagcatcacgcagagatgacaagatatggttttatacttggggcagctcagaaggactctgcccagaaaagagggcaccatgttgagttgaaccagatagctgattggtttaagtttagaatctttgagaattatggcttttccctggaaccaggaggtgagtgcagggcccagacagaatagaccttgtttcccctatagaagggaacaaaaggtggaggaagggaatgaatggcccagggctcattcttagtggagggatgagagtggctgtgtgcctggtctctactgttgcaggctcttacctgagcctcctggaaagccacgcactgcaagaaatagcagatgggcctgccagacagtatggaccacagtggtgagcccttcagcaccctgggtggtgtggacagccactgatctgttcactgtcccaggccaggtcttgtctcagaaatctttgaaagccaacggctgttctttatacaatggccctttaacaaaggggaaatggtttcaataaaaatttgcatatgacatgtaaaagaaccaataaagaaatctggactcctttcagagagcccagtttcaaattagctcagctgaggtaggttttgagggcacatgttcatgcaccagtataaaatctacatttccgtaattgctgaagaataatggcactgaaaatttcctgagcggccgggcgcggtggctcacgcttgtaatcccagcactttcggaggccgaggtgggcggatcacgaggtcagcagatcgaggccatcctggctaacatggtgaaaccccgtctctactaaaaatacaaaaaattagccaggcgtggtggcgggcgcctgtagtcccagctactcgggaggctgaggcaggagaatggcgtgaacctgggaggcggagcttgcagtgagctgagatagcgccactgcactccagcctgggtggcagagcagagactccgtctcaaaaaaaaaaaaaaaaaaaaaaaaattcctgagcagccctggcgggcgtccttccttatccacagttccctgcattgcttgcagtcttccttcaggctagcattggtatcaggaatttgggaagttcttcatgcctgtttcctgttttgtgcttttccctcaagtgatgactatctaaaatttggccacattctcagctgtgagattctcaacttaaacagtctctccagataggtagtgagtaggaaaaggcacaaaccacttttcctctgctctcacgccacagcaaccaacacagaagacttcggtgaccacatgtgtgaggggggtttcccacacacccagcgagcagtcacttctgcagcagacaccagctgggtggcctctgattcagttcagatgtgacactgtcaaattggaggtagcgtctcatcccacgggttgagggctcagtccccaagactgcaccccccacacacaccagtcgcaagtctgagtctcagggacttctgaccaaccaccttcaagttggggttcccatgaccccctctttagtttccattactttgctagagtggctcacagaactcagggaaacatttacatctatgataaagaatgttacaaaggatacacatgaagagatgtgtagggcgaggcatggggaaaggggtgcggaagagcttccatgccctccctgggtgctccaccctccaggaaccttcttgtcttcacctgtcaggaagtctccagccccgtcttcttgggccttttatggagccttcattggataggcctgatagaaatctgtgtagaaatgtgattggacaaaaagactacaatccagtcctaacagaccgaggagaaagccacaaggtctgcctgttgagattcttgttggcctctctgtgtagcgttccttccccctaggtgtgccgcaggacccttcaggaatatggggatcttaagacctgcattcattcaaggcggtggaggatttctttatggaaaggttggggaagattagatcttgctttgggcaggtaaaagtttaagaccagcctgggcaacatggagagaccccgtctctacaaaaataaaaaaattatctgggtgtggtggtgcatgcctatggtcctagctgcttaggaggctgaggtgggaggattggttgagcccaggaggtcactgctgcagtgagtggtgatcatgccactgcactccagcctgggcaacagagtgagaccctgtctcaaaaaataaaataaaataaaataaaataaatgcatccatgtgagggaaagacctcacgcaatcaggaaataggctgcctcgtatctggcacatgtttctcctgctgtggggttgacttttcctgcctaatgctcatccggctggtcattttacccatagattatggaatcagggcacgaccacttgaagccaggagtttgaggctgtagtgcactatgatcatgtctgtgagtagccactgcactgcaacttgggcaacatagcaagaccgcttctctaaacaagtagaaaaaaggtcatcatttagaaggctggtgggaaagggcatagagtgttagtgtctaatagttacgcagtttcagttggggaagatgacagagttctagagacggatggtggtgacaggtgcatcgcagcatgaatgtaccacacaccacagaactatgctctgaaaagtggtcaagatggcaagctttatgttacatatattttactacaattttgaaaacagtcatctgtttgcattttggtcaagttgaaatcagtaggttatagtaaaagactgttaagttcattcgtatccctttattggtcttaatttttatatgctagtattagcaattaaaattttttttctttttttttctctttagcaattaaaattttaattgctaggccaggcccggtggctcacacctgtaatcccagcactttgggaggccaaggcgggtggatcacctgaggtcaggagttcaagaccagcttggccaacatggtgaaaccccatctctactaaaaatacaaaaattagccaagtgtggtggtgcacgcctgtaatcccagctactcaggaggctgaggcacgagaattgcttgaacccgggaggccattgcactccagcctgggcaacagagcaagaccctgtctcaaaaataaaaattaaataaataaaaataattgctagtgacaataattatatgtacaggacacataactaatcacggaatttggtgctggacataagactcactactttctctctatgtgaatctttaaattagaaaattccaaaggacagaatacataggtctgtgactccttccaaagatatgggttgaaactgcatctaccatgacgagcatcggggccacaactccgacgttctctaatagggcatgaacagaacgagaacaggtttattttatttttaaatgccaatagtgccattaggagtcattcttctttcccttagtcgtataaatcccctattatttggtgatgcaaaagtgagctttcacgcaggtcagctgcacctttcacgtaggtgcgccaaggtggcagtgagcagtgtggccggggtgggggccggcctaaccagtgtctccgtgttcccttgccatcccgtgcccaacagcaggagctcatcgagagcatcagccgcaagctgcaggtgctccgggaggcccgcgagagcctgctggaggacgtgcaggccaacaccgtgctgggggccgaggtggaggccatcgtgaaaggcgtctgcaagcccagcgagtttgacaagttccggatgttcattggagacctggacaaagtggtgaacctcctgctgtcgctgtcaggccgcctggcccgggtggagaatgccctcaataatttggacgacggcgcttctcccggtgatcgggtaaatgcagatacgtctgacttggaaatggggggtggtctcgtgggaaggctgtttttcaagtgtcgtgaaagtcagctccttggagcctagcatagcttccacatggcctgtccacctcctcctgcagaccttgtcgagacagtgcacgctctataccctctccttccttttatatttctttagttgtttgtttgtttgtttgtttgtttgagacagggtctcattctgttgcccaggctggagtgcagtggtgcgatctcggctcactgcagcctctgcctcccgaggttcaagagattctcccacctcagcttcccgggtagctgagctcccaggtgcatgccaccatgcctggctaatttttgtatttttttggtagagatgggatttcactatgttggccaggctggtctggaactcctgagctcaagtgatccgcctacctcagcctcccaaagtgctgggattacaggtgtgagcaactgtgcctggcctccttccttttaattgaggggaaaaggtgcttatcagatgcagggagttgaaccgtcattggactgcagggttgcgggatcttctcaaagaactgttacctctttttaacatctttttagatattcctattgactcttactgataattgtctcttcttagaaaaatcatgttgttgttgtttttacttttcttttaccatgtataagtccgtaacagacatgcctgcctgctgacgatcgtaagtactcaatgatagctattttcttgtggtggttgtagctgtgatttaacaagagggcatgtatcagtctagaaggaagcagacagtgcatctaacttcaaggcgtttctcagtgggtctgtcttttcgtcctttcacatatgaaccaagagaaataatagctgcctcgttggcttttacctcataggccaaatatcagtaaaacagctagttttgtttgcacagaacaggccttcagaatgttcatctgtatcatgaataaaacatcttaacctctctcagaaggggagcagaagaagcacccttcccctttctccaggtgagggtgatttgggccacgcagaacgctgtcctggcgctgggcttggagacggtgcccttctgcactcagccgagtgcttagtaactgtgtcgtggaactagctaggtcagggtggcaccgtgcccgagggggctgctggccgacacccgtgcacagcactgcgtcttctccaccctcaggcttccttgtgtgcagatatgctctgcaggctcgggggcttctcctcctcctgccaggagcatttagtaagcctaccctgaattcctctcgagtccacccatgtggccagctgtcccacggtgttcccatggagcggaccttgacgccaagagggccccgcagtcctttgccctttgcagcatctcagaattctgtcgttgtgagtcccttggtgactcttctgctcaccattcgaggcaggtgggagagagtcaggctcagacagcaagaggaaacccagagaggcctgtgggcggcttctgggggcctcaggctggcccgctgcaaccatgagacacatgcccccaggccctgggccctgggtttgtctgtgtggaccccatcggatctctggtggcatcagggtttccatcgataagttgtgggaccagcccacaagttgccagtgtcttcaagggttggccagtgccccagctttcatcctggtcctcaacaggcttgtttgtctgtcaacagcaatcactgcttgagaagcagagagtcctgatccagcagcacgaggacgccaaggagctcaaggagaacctggaccgccgcgagcgcatcgtctttgacattttggccaactatctgagcgaggagagcctcgcggactatgagcacttcgtgaagatgaagtcggccctcatcatcgagcagcgggagctggaagataaaatccaccttggtgaagagcagctgaagtgcttattggacagccttcagcccgaaaggggcaaataagagaccagtccccggtggaggaggggcacggggcctccgagctccagctccgttcccaaggatactcgtgaagaccccatctgtgttcatggcctggaaagagacttctcccatagcaaagaggctgttataaaagcaataacttttgtgtttgtgtgggatgatttatttaattttttagtttcccctttgattgctgagagccattttcctttacacataactacacctgacaccaggctctgctggatgtgagtttccactgcatgggctgtgggctgggcctgtggtgcctgccgagtggtcactgtcagtgggaaacccgttgttcctcccgtcttcagatgctgagccaactgcttggacagcagccagcgcgtcatgacgtgcatgagagggggaccctggtgctcatcttctcttgtcattcatccaggcatgggctgccaggttttgtccctgctcgttcaacagtgtgagcatttgtctctgttatctaatgatgttctctgacccagcagaaatcatcatcatgatgatgataatttattaactttttggaagggtgaatagtttcctaatggttaaaaaccaactgtgaaaggaaccacctgtgtggttgggttcactcattctcagattaaattgccacttaaagaaataacgtgcatgctttaaaaaacacagtcacgcaccaagcaggcaaatagctttagtccttctcacctcacatcacagttgttctgcaaagtaaaattttttggttaagagcgtgtccagtagtaatgtgcttgttagctgtttctcaagaccaacagaagattttttcagttactttccccccatgtattttgtatgcatatgattgtccgtgataattggctacttttccattgtttcctccttaaatcgtttagcatggcatgagggccacattccatggacgggaagaccccttcctcttcagaggtcccgtggactacacagctcctgagcttgatctttttctgccatgaagtttaaagattctatgcccatttccttgattgaaatggcaggattctaaagagagcctggtttgttaaaagaaaacactgtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggagatgtctttgatttacctactttacagcttttgtaaaaaaagaatgtcctcaccatacgtcagattcttaagccatctgagtaaaccgtgggattgattatatgtgtgtaatttatttacactagtcggtttgtggtgaggaaacagggaccaggtcgcatcacttagctggtgccccagtaatgctgtgtaacaaactgtaaaatgtcagcaataatctgtgcaacaaagtattgacttagctcatgaatttgtagatgagctaattcgggctgggctctgtgctgtgtgcctctcctcttcctcatgggaccagccgtgtggctggatgtgttcatggcaggggcacaagacaacacaccctgtcacaaaggggcttctcctggctttgtcctgtcatacctgctaaccttcttctggcaaagcacatctcctggccaaccccggcaccaaagggtgtggaacaggctccaccttttagtggaggaaccgtaaattcacatggcagagtgtggacacagggagggatgaagaactggggctgtccatgggctccatctcgcccgcctcctcgtgtctactgataatggagtggcaccaaagtggctgggaccacggagtcaagttgcctggagcaaagccacctctgtcactgctagttgtgtggccacagcaagtaacccagcctctgtgagccccagctcctctctcgtaattggagatgggctgctgtgaggtcaagtgagttgataaatgttggtgtgcttagacgccatgcttggttcacagcacggctgcataagctgtgaatacggctcttatcctgttgtgcacctggaggaaacactgtccctgtagtcagaatagatcgcccgccagaaccacccgagaggtagataacggttgatttcttttatttggtaggattagaagtgtttctgctagggagcagatttgtgagacctgaaggttaggcagtcagggttatgggaaaacacttggaaaaaaagacgcagcctttctctgtctgtcgcccaggctggagtgctgtggtgcgatcatgactcactgcagcctccaactccagggctccagtgatcctcccacctcagcctcccaagtagctgggactataggcgcactctctaccacacctggctaattttttatttttgcagagacagcatcttgctgtgttccccaggctggcctcaaacccctggcctcaagccatgctcctgtcttggcctcccaaagtgctgggattacaggtataagtcactgcagcccagggatgggtttatatgtgttttcttgtgtttgtttaaactccctttctgtctatgattgtcagattttttttttttttttttttttttttttttttttttggagatggagtctcgctctgtcgcccgggctggagtacggtggcgtgatctcagcttactgcaaccttcacctccctggctcaagcgattcttgtgcctcagtctcccaagtagctgggattacaggtgcccaccattatgctcagctaatttttgtatttttaatagagatggggtttcaccatgttggccaggctggtcttgaactcctgacctcaagtgatccacccaccgtgacctcccaaagtgctgggattacaggcgtgaaccaccgcgcctggccttatgatggtcatatcttaatttatatgtttaacctcttgttaaactttgggctgtaaattagagcaggttctgtgattcggtctaatgttttctaatagtcaaaaagtggaaacagctccgatgttcatcagtaggagaataaataatgatagtctactatgtacaatagaatactgctcagaaatacaaaggcatgaattactgaagcacacaaaatataagaatgcatctaagaaacactgtgccaagtgggagacggctcaggtaagaagagtgcctgctgcaagacttcgtttatgtgaagttctagaatgggccaaattgtctgtggtagaaaatatcaaagtcatagttgtctccagaggtgggggtgtgcacagggtacttggggtgaagttcatgttctgcaaatggataggggcatgggttacacaggtgttggcttttgtcagaatccagccatcatgtacttaagatttgtgcattttacgagagaaggaaaaaataaatattgaactgcacttcatgctatgcgggctgatgtgtttagggaggaatatactgatgtctgcaatttgctttgaaatgcataaaaaataagatgggtgaatgggtggggagagatgaataggtgtattgatacgtgataggcacagtaaaacactaatggcagaaacttggtggtgagtatacaggtgtttactgtaaaatcctttcaactttgctgtttgaaaatgttcttaatcacacactgggagaaaataggcacctcacccaacatagccttcctaagagccttccagatgatctgtctgctcttaggtgttcacagaaaagatgcaaaagccatttcctgggcatatagttcacttattctcttgttgatgtattcatacagatatagttattaatattctttctctgtttaccagaaaattataatatggtatatttgtttgttcttgcattgctacaaaaaactacctgagactgggtaatccataaagaaaagaggtttaattggctgacagttccacaggctgtacaggaagcatggctggggaggcctcaggaaacttacagttatagcagaaggtgaagaaggagtcacgtctcactaggttggagcaggagggagagagagaagggggaggtgctacacacttttaaacaaccagatctcatgagaactatcatgacaacagcaagaaggaaatccattcccatgattgagtcacctcccaccaggcccctcctccaacattgggggttacaattcaacatgagaattgggcagtgacacaaatccaaaccatatcattctgcccctggcccctcccaaatcatgtccttctcacaatgcaaagtacaatcgtcccttctcaacagttgcccagtgttaactcattccagcattaattctaaagtccacagtccagagtctcatctgagagaaggcaagtcccttccaccaatgagcctgtaaaataaaaaacaagttacctccaacattcagtgggggtacaggtattggataaataatcccaatccaaaatgaagaaatctgccaaaacaaaggggctacaggccccatgcaagtccgaaacccaacagggcagtcattaaatcttaaagctccaaaataatctcctttgactccatgtctcacatccatgccatagtgatgcaagaggtgggttcccaaggccttgggtagctctacccctgtggctctgcagggctcaactctcatggctgctctcaagggctggcgttgagtgcctatggcgtttctaggtgcatggtgcaagctgccagtggatctaccattctggggtctggaggacagtggccttcttcacagctccactaggcagtgccccactggggactctgttggggggctccaaccctacattttccctgtgcactaccctagcagaggttctccatgagggctctgcccctgcagcagacttctgcctggatttccaggcctttccatacatcccctgaaatctaggcagcagctcccaagcctcaactcttgcccactgcacacctgcaggcttaacaccacatggaagctgtcaaggcttatggctaccaccctctggagcagcggcctgagacacatctggggcccttttagccaacgctggagctagagcagctgggacacagggagcagtgtcctgagaatatgtagggcagcaggagccctgggcctggcccacaaaaccatttttccctcctaggtccctgggccaataatgggaggggctgccgtgaaggtctctgaaatgccttggatggattttccccattgtcatggctattaacattcagctcctcttatgcaaatttctgcagccagcttgaattctccccagaaaattagtttttcttttttaccacatggtcaggatgcaaattttctaaacttttatgctctgcttcccttttaaatataagttcctgtttcagatcatctctttgcccatgcataggaccatatgctgttagaagcggccaggttacatcttgaacactttgctgcttagaaatttattctgccagataccctaaatcatttctctcaagttcaatgttccacagatctctggggcaggagcataatgcctccaacttctttgctagcacataacaaaagtgacctttgcttcggttcccaataagttcttcatctccatctgagacaacctcagcctggacttcatagtctgtatcactattggcattttgctcacaacaatttaacaagtctctaggaagttccaacctttccctcattttcctgtcttctaagccctccaaactgttccagcctcttcctgttactcagttccaaagctgcttccacattttcaggtatctttatattaataccccattcctggggtattgatataattctgtattaattcattctcgcattcctataaagaactaccagagactgggtaatttataaagaatagaggtctaattggctcacagttctgctggctgtacaggaagcatggctggggaggcctcgggaaacttacaatcatggcagaaggcaaaggggaagcccgcatgtcttacatggccagagaaggaggaagaaaagagaaggggtaggtgctacacacttttaaacaaccatatctcatgagaattcactattatgagaacagcaagggagaaatccacccgcatgatccaatcacctcccaccaggcccctcttccaacattggagataacaattcaacatgagatttgggtggggacacaaatccaaaccatatcatacagtgtgcatgaaggacttcaaagggatgttaaaacatttattttttatacatgtgcatcaggcaaagaggaagttttttacaaatccctgtacatactcttgccccttaaaacactgtttgacgtgtggtgtcatccaagtttcatgtcagggttcgaagttgatataatcgctgcttgctttgctgagttgctttaacatatctggatatcatctttctgtgtgtagagcgtatacccaggtgcctctgcacacatttgttttttcatcaaatgtttgttgagggtatcctcaaacccctgtgctctttgagtgttggatctttgctctgaaggcaggaaagggagtgctgagacagcaaaggtgactggaatgccaggagcctcatctggctcagaagaagcccccaagggcaagcagcatccttgatgtggtgagctgaaagccagctctccctaaagatctgtggccccctggatggatgagttcccttggcgtcttgctatgctatttttgtgatccatttcagtcaaagatgtgtgaaaagcattttataagttgtaacgtgccctactgtcactaaacctcataccatcaattttataaagctcttttagtgagaccagccttgcagcaattgctctatatttaggaaagcaaagatggatattacaaaccacaaaactgccccgttcaagagttttttacctacatgataattttgccttctccctgtgttctctcttttcataggatttcacctacatatctgtgcgtgtgtgtgtgtgtgtgtgtgtgtatttttttttttgagacaggacctcactctattgcccaggctggagtgcagtggcacagtcacagctcactgcagcctcgatctctctgggttcaggcagtcctcccgtctctgcctcccaagtagctgtgactacaggcgtgcgtccctcacctggttaatttttctatttttttgtagagatggagtttcattatgttgtccagatgggtttcgaactcctgggttcaaacgaccctcccaaagtactgggattacaggtgtgagccaccctgcccagcctacatattaattttgcttttgaaaagggaaagttaagcgaatgagaactgggtgtcgaaaggatccagagattaagatgtacacatcgagatccccagcctggtggtggcgactccatcgtaagcctggagtgtttctccactgacttgacacaagtacatccagctgccctatctcaatagtgagttgatttagagcaaacacgtcctgtgaaggaatttttagacatttttgctctattacagctcattatgtaggcatttaaagagagctcaagaatatgtaggaaaaaatgtttctaaaaattctttgttttctctggcatttcctaagttctaaactttaaactttttcttcagagaggaatttatttttataccaatgacatttgattactcaactggatatacttaaacagctaaacattctaccagaagactgacgtccttgttcatatccgatcatatataaatactggcctatgaacaaaactggggagatgtgttaccctttttttgttatttattttttttaatttaatcattattattgttgttattattattattattatttttgagatggagtcttgctctgtcacccggactggagtgcaatggtgcgatcttggctcactgcaacctccgcctcccaggttcaagtgattctcctgcctcagcctcctgagtagctgggattacaggcacgtgccaccacgcccagctaatttttgtatttttagtagaaacggggtttcaccatgttagccaggatggtctcaatctcctgaccttgtgatctgcccacctcagcctcccaaagtgctgggattataggtgtgagccgccgcgcccggccctatttatttattttttgtggcccattctaatcaaaggaagaagaaaaaaaagaatatagcatgcagggagagtttcaaatacgaaaaaccctgagtgtgaatattttgtttacattattctgctcgtgcagaattttcagtcttaaactatcgcctgtagaacggatatttggaattagagtactttttaaactattactggcatgagcctttcttcttaaattgattcaaaggactcaaactattagcaaatattacatgttgtcttaatccgttcaggcttctataacaaagtaccatagactgagtgaatcataaacaacacagaaattgatttctcacagttctggaggctggaaatccaagatcagggtgcccctgtggtcaggttctggtgagaaccgggttgttggcctggttgtatcctcacatggtggaaagagagcaaagtagctctcaggcctcttcttataagggcgctaatcccattcatggggagttctgcccccatgacctgattacctcccaaagatcccacctcctaataccagcacactggggttaggatttcaacatctagttaggggataaggggggcaaacattcagtccataacagttgtcaactttttagcatatataagaaaagcatgttcaatttttttttcttatttttgagaaggagttttgctcttgttgcccaggctagggtacaatggcgcgatcttggctcactccaacctccgcctcctcggttcaagtgattctcctgcctcagcctcccgagtagctgtgccaccaggcccggctaattttgtatttttagtagagatggggcttcaccatgttggccaggctggtctcgaactcctgacctcaggtgatccacccacctcggcctcccaaagtgctgggattacaggcgtgagccaccgcacctggcttcttcaatgtttttctaagtttgattgaaaaagaaaccaaaatggtatttatgaattagaagggagagatgtagatcttaatgtatatgacagctataacctaaaggttgcaaggaaaaggacacacctagtggtaaagttgctacattcctctggaagtaatgaaatattaattctgaataggctatggaccgggcacagttgctcacgcctgtgatcccagcactttgggacgccaaggcaggaggatcgcttgagcccaggagttcaagaccatcctggcagcatgacaaaaccccatctctactaaaaatacaaaaaaatcagccaggcatggtgacctgcacctgtagtcccagctactggggaggctgaggtgggaggatcacttgagcacaggagacagaggttgcagtgagctgagattgtgccactgcactccagcctgggcggcagaaccacgccctgtcataaataaataaataaataaataaatagttttttcaaaataggcaatgaaatgcctgtgtattgtcatctctagaacaagcacttaaaaactgtacaaagagattcagacaactcaatagataactttcgaccttgctcagatagcccaaaagagggcagtagaagggaagccgcaacaacaacaaccagaagaaacaaaacaaatattaaaatagcagacctgcctgggcgcgggggcacacacctggaatcccagcactttgggaggccgaggtgacaggatcgcttcagcccaggagttcaagaccagcctggaagacatagggagaccccgtctctacaaaaaaaaaaaaaaattacctgggtgtagtgaaatgtgccagtgttcccagctactagggagactgaggcaggaggatcactggagcccaggaattggaggctgcaatgagccatgatcacactactacactccaacctgagcgacagagtagaccctgtctcaaaaaagaaaaataaattctccaaatactgtaaaaaaaaaaaaaaaaaggaagtggctatttctgctctccacatgaaaatctgttatatgacaacacttggagttcatcaaacacttggagcccagtgggagcaagactgtacagctacctccctccaagttcagattggccctcctgccttctgccacagaaggggactggtggtctggtgattatgggcggcggcggtgaagggggtaattgggggcatcggatatagattctcaggcactatttctactgacagtcccccgtacttcccccgccgacaccccactccctgcagaagcacctggtaccacaaagagtcttgctcctggcaggtctgcatctcagccttctggtctacccagccagttggcatttgtctatcacctttcctgctaccaggatctttttggtaaatcatctgctgtgttctctgagggttaatgcctcttttaagctgtttctgtcattttagtgggctttgaggagagggtgtagttaaatgcatgtgtgcattgcttttttttttttttaaaaaagataaccaatagtgcagaaaagcacataaacttgtcacattgtaggacactgaagaacaaaagagatcacatagaattccccagccagtcaggagtctgagaccagcctggccaacatggtgaaaccccgtctctactaaacatacaaaaaattagctggacgtggaggcgggcgcctgtaatcccagctactcgggaggctgaggcaggagaatcgcttgaacccgggaggtggaggttgcagtgagccgagattgcaccactgcactccagcctgggcaacaagagcaaaactctctcaaaaataaaaaataaaagaattctccagccagacataggcagtgtgttagtgtcctattggtgctgtaacaatttaccacaaacttagtggtttaaaatgccacatttacgcattacagttgtgaaggtcagaagtctgtaatctgtcacgccaagctaaagtcaaggtgtgagcagagctgtgttcctttctggaagctccagggagaattggtttcttgcctgtctagtatctggaggccaccccatttctggtctcacgaccccttcctccatccgcaaagccagcagtctagcgtcttccagtctctccctgaccctccttctatcatctcatttccctccctgaccctcttgcctccctcacacaagaacccttgtgatgacactagcccacctggataagccgggatcatctccccacatctggatcctcgattccatcacagctgcaaagcctgttttgccatggaaggcaacatagccacgtacccccttccttccttcctgccctccctccttcccaccttccttccttccttcccccattcctcccctcactctctccttccctccgtctttctctccctctttcccttcctccctccctccattcttttcctccctccctgtctcctttttccttttgctttttttaaggaaacaggattatataataatattttcgaaatctgctttttacttagcagtattgggaacgttttccttaattattcttcaacatagtattgaattttggtgtgatatcccattataaggatataaaatggtttactgaacagttctctaagtgtggttttaggattttgcctttttgtcccagttgtaacctcagttacagagttcattgggtgtgctttgcacttagatctttgcacacatctctgctcatttgctcagaataaattccttcttatggaaaccctgtaagcaaaggagtccggtgggattttgacttccatgtaatgtttagtcctacatactgggtagctggcatcgtttgccttttggcagcctcatttcttacacaggttccatttgaagctgtccccagtcttagcaggtcagtttcacacactccgcatcttccacttgtcttacctaccgaaactgttccaacaagcctgtaattcaagacttagctagaaaaaggtcatttcccatgaactaacagtgtctttcccagctggcgcggtggctcgctcctgtgatcccaacattttgggagggtgagacaggcagatcgcccgagtccaggagttgaagaccagcttggacaacaaagcgagactccatctctacaaaaaatacaaaaattaaccaggcatggtagtgcgtgcctgtggtcccagctacttgagaggctgaagagggaggatctcttgagcccaggaggttgactgaggctgcagtgagttgcagttttgccactgtactccagcctgggggagagtgagaccttgtctcaaaaaaataaaattaaaattaatggtgtctttcctaatacatgggttgtcagtggccttcacaactcaatctcatccaggttggtgccacttctgctaacgcctgtacttatatattaccactgcttaaaaaaaaatgtcggccaggcacagtggctcacgcctataattccaacactttgggaggccgaggtgggcggatcacgaggtcaggagttcgagaccagcctggccaacatagtgaaacccccatctctactaaaaatatgaaaaaattagctgggcgtggtggcaggtgcctgtaattccagctactcaggaggctgaggcaggagaatcgcttggacccaggagccggaggttgcggtgagccgagatcacgccattgcactccatgctgggtgacaagagtgaaactccgtcttaaaaaaaaaaaaagcattacctgcaggtgatatgagttagacaccagttctagggctggtggggagagagaaattaggagcccatacgaatgttggagtggaccctgcaggtgtattagcaaacatacctaccctccaaaggctgacagagcaaaagaggctacatgatgaagcaaatgaagcaactaaagggtggtggctgcagcgacctcaggacctaggactgacacctggatgagcagggtgactggtggaatgtgggaacagaacagaacattgagggagggcctcagaactggaaaccatggctaccgtgttgatgagaactcccagctgcctggaccaagaagccggtgctgaagaactaggcaggacgtccgagaggagctgtgtccatgtcggccccgctggccaggtgagctgactgccctcccctcaagccaccggttcatgcgaagaccacgtcgctaggtagcggaggttcattccctctttattgtgtatttatttttttattgtggtgaagtatatgtaacataaaattgaccattttagccatttaagtgtacagttcaatggcagtaagtacatgtaattgttgggtaactgtcaccactgtccacctccagaactttttatcttccccaaatgaaactctgtccccgtgaaacatgaactcccctttagttcccgccagcccctggcaactaccacctactttctgtctatgaatttgactctctattacaggtacctcccatatgggtagccagacagtttttgtccttttgtgactggcttctttcactcagtgtaatgtcttcgaggttcgtttgtgtggtagcctgtgtcagaacttcctttttgagactgtggatagaaatcgtatttctggtgtcggtatagaccacatttggcttccattgtctgtgggtgggcacttgggttgtctccacctttggttactgtgaataatgttgctatgaacatgggtgtggaaatatgtctttgagtccctgctgtcccatctttttgagtatatacccagaaatggaattgctggatcacatagcaattctttttttttttttttctaagaggaaatctccctctgtcacccaggctggagtgcagtggtgtaatctcggctcactgcaacctccgcctctcgggttcaagcaattcttgtgcctcagcctcccgagtagctgggactacaggcacacaccaccacacccagctaatttttttttttttttttctactagagacaggatttcaacatgttggccaggctggtctcgaactcctgacctcaggtgatccacccacctcggcgtcccaaagtgctgggattacaggcatgagccacgcaccaggcgctttttttcttttttgtgagacagggtctcgctctgttgcccaggctggagtgcagtgagatcatggctcactgcaacctcgaactcccaggctcaggtgatcctcccacctcagcctcctcccaggtagctgggactataggtgtgcactaccaagcctggctaatttttgtagagatggggtttcactatgttgcccagactggacttaaactcctgggctcaagcaatcctcctcccacctcagcctcccaaagtgctgggattaaaggtgtgagccactgtgcctggatgattttcctacctttttaaggctgaataatattccatggtatggatagatcacgtgttgcttctccattcatctgtcaatggacacttgagtggcttctgccttttggctactgtgaatgagctgctatgaacatgggtgtgtcaataactggtcaagaccctgctttcacttcttttgggtatatgcccagaaggtgaattgctttatcaggtggtatctgtttttttacttttttaaggaattgccatactgttttccacagcatctgcaccattttacattcccatcaacaatgtactaaggatcccatttctccacatccttgccaacacttgttattttgtttctttaaaatagtagctggctgggtgtgatggctcacgcctgtaatcccagcactttggggccgaggagggtggatcacctgaggtcaggagttcaagaccagcctggccaacatggcgaaaccctgtctctactaaaaagacaaaaaaaattagctgggcgtggtggcacatgcctgtaatcccagctactcgggaggctaacgcaggagactcgctggaacccaggaaggcttgcagtgagcggagatcacacaccactgcactccagccttgggcaacagagcaagactctgtctcaaaaaaaatttttatatttatagtgagtgtatgttcttacactaaggacggtaaataaagtaggaatcaggaggccttcacaggactggggttaatcaaaagtcaacactgctggattagcatccaagatggagtcacttttgtctccacacagggctgttcctgtgtctgcatcttctctgaagagccatctcgaaatatgccgaaaaaggatatatatctcttttgtgtatgaacctgtgtgatacctagcgaagcctacggacctttttccagaaaagatgcaaaaacaaggtgcccaggattacacttattttgaaatgcagttattgaaccaggcacagtggttcatgcctataatcctagcactttgggaggccgaggtgggaggatcacttgaacccaggagttcgagaccagcctgggcaacataacaagacccccatctctacaaaaaaatacagaaagaaattagctgagtgtagtgggacactcctgtggtcccagctacttgggaggctgaggtgggaggatggtttttgcccagcaggttgaggctgattgagctatgatcacttcactgcactccaatctgggagacagagaccctctctctaataataatcatcatcatttgttcaagaatatcttgccaaaaagaatgattactataaatgtggcatccgccaggaatgttccggccgttaggagggacttctgacatcagcctggaacaacctctgacccatccctccccagcatgcctccccgataaagttcagaccctcagtgttctccagcaactctttctttccttcctccctccttccctccctccctccctcctgcccttccatttctctctccctccctcccccttccttccttccttccttccttccttccttccttccttccttccttccttccttccttccttccttccttccactcacaatgtctattttatcccatctttattcatcacttaaaaatgagtgtctctttccagagtggatcttccttgggaagtcggggagaggtatgtgagctactcctctgtacccttcccagcacccaggagagcctttcaaagttttctgcatatacatgtgggtgtcttttaaaaacaaaactgggggcatacaactacacacacacacacacacacacaaacacaaacacacacaaggagacacacaaacacacacagggagacacacacaaatacacaacacacacacacaaggagacacacacaaacacacacaaggagacacagacaaatacacaacacacacaaggagacacagacaaatacacaacacacacaaggagacacaaacacacacaaggagacacagacaaatacacaacacacacaaacacaaacacacaaggagacacacaaacgcatatatatataaaacaacatgtatatttatacattcttttgcatccttttcccacttagcaaacagtgacaatttcctgtcactaaaatgcttttgaagacttcattgtaaatggttgaatagtatgctatatcacctggaattatgaaatgtacttaagcatccgtattgcttcacatattacttgtctccagatttctcttattcctagtgtcaacaacacccctggtgagcatcagtgcccagacactttgatcccacttctctgatttgtccactagaattggttccaagaaataggagattgggtcaggagacagccatgtttttattactcttgataataattttttttttaggcggagtctggctctgttgcccaggctggagtgcagtggctctatctctgcttactgcagcctacaactcccgagttcaagcgattctcctgcctcagcctcccgagtagctgggactacaggcgtgcaccaccatgcccggctaatttttgtatttttagcagagatggggtttcaccatgttggcaaagccgggctcaaactcctgacctcaagagatctgccctattcggcctcccaaaatgctgggattacaggtgtgagccaccatgcctggccttactcttggtaataattaattaatacacttttatgtttgtgtctctgtatgctcaccattttttccaattaaaaaagtaatagaccttaagacacgaaaagagaaatcaccagtaatcctaatattcagatgcatcttgttttgtcttcccagcctattttatgataggcaaaaataagatgatactactatagatactaacgagtttgttatctgcattttagatccaacccaccatggacattttctcacgttactaaatctttttctactttactatctgcaaagtattataataaatgattggcttcattttaacatatactaggtagtaaagtgtatttatgtactcaaactaatgaatcttccattgcttgacaacattttattggagacatggtcttgctatgctgcccaggctggtctcaaactcctcggctcaagcaagtttcccgagacaactgttttgtgaaatattttttattgttttcttgttttaaataatcatgcttattgcagaaatatttgaaaatactgaacagccaggcacctttaaaaaattacaatctgagtgtcataaatggacacaacattgcgtgaaagaaaccagtcacacaaaagcattgaccgtatgatccccattttgaaaaacaggcaaaatagaagtaagatgtgtggggatgcatgctgagatgacaaaactatgaaagcaagcaaggaagtgggaatattgtgtatctgaaatgaaatgctggctccatgggtgttcaccccaccatcgttcattgagctgcacacttgtgtgcttttctatatgtgtgtgacccttcacaatccaaatagcttagaaaaaactcagaatctctcaaacccagttaaaaatgtctcctaatagcttaggatgtagattttcagttcgatttgtatctatgattatatcgtacatattattttgaaacatgtaatttgtatttgaaatattacggacacctcccttttggtcacacagaatgtcaactagaatggctgtcatgaaaaacattaaaaataccaaatgttggagaaaatatgaagaaactggaacctccatcattgctggtgggaatataaaatggtgcagccacgtgggaaaacagttgagcaatttacaaaaagttaaatgcgcacttaacatatgaaccaccaatttcactcctaggcatctacaccagataaacaaggacatatgcccatacaaacttttatattcaagtgttcatgacagcatagtttataatggccaaaacatggcaccaaaccaaatgtccaaaagctgatgaatgaacaaactgtggtctacccacacaatggaacaccattcagcaatgaaaagggacaaccttctcatacctgctgcaacatggatgacccttggaaacgtgccatgtgaaaagagccacacaaaactcttataccttgtatgattccatttgtattgtcaatgttggcgtatagctccatcgcgtggacatagcataaattccttcaccaagccctgttgttggacttgacgttgttccccggtttccaatattacaagcaatgctgtgaggaccatctttgtggctacatatttgtggccgaccttattcatgtctttgcaccaatgcccagaagtggaactgccagtctgaaggtgtgtgcattttaaagctttcgggaaatatcgcggagcggccctgcacaaagtttgctcagactgcactcccaccagcagatctagagggtctagtgtctcctttctccaatacaacacctccctcttggcgctactcacccatgggaggctgtcccaggtcccagggtccccccgctcaccatgctctgtatttgtttgtagtttcctgggtgcgctgccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtcccccgtacggccaagtgcatcctggtatttcagaaatgtgaatttcctggttgcattggctttgcaaatctaagatttctgggagtttatggaaaatgttattagcatgctctaccaaatatttccaacgactcaagaccgtggcatgggtagtttgggacagaaggtggccaactgcctccttctgttatcttgtgtatctgaatgtggctcactgatttgttggttgaattgagaacttttatttaaaagtcttcccacctgccagttggtcttattgcatctgaattttaattattgttggctacagcaaataatcaaccctgtaaactaagagtagggaaataagagtttctgagtacattaacttctcacatttccctcttaaacttttgctacaaacaatcataggccaggcatggtgacttacgcctgtaatcccagcactttgggaggccgaagtgggaggatcacttgaggccaggagttcaagaccagcctgggcagcatagcaagacctggtctctacaagaaaaaaaaaaaatagctgggtgtggtggtgcgtggctgtgattctagttacttgggaggctgaagtgcgaggatcacttgagcccaggagttggaagctccagtgagacgtgatggcaccactgcactccagcctgggccatataacaagaccctgactctttaaaaaaactccaataaacaaaaaaccaagaatggaccttattttctatgtcatggtaataacatctccctaccatataaagttttctaaaatgtgcaaaagtagagaggatagcataaggaatctccacacacccattgccagactccacagttactgagattagggcacttctgctttctctttccattcttttacctttctaatctatgtttctttttcccaagtttttttttttttttgagacagagtcttgctctgtcgcctggacttgagtgcggtggcgtgattttagctcactgcaacctctgcctcccaggttcaagcgattctcctgcctcagcctcccgaacagctgggattacaggcacctgccaccatgcctggctaatttttgtatttttaaaaatattggggttttaccatgttggccaggctggtctcaaactcctggcctcaagtgatccgcctgcgtcggcctcccaaagtgctgagattacaggtgtgagccactgcacccggcctctttttcctaagtattttaaagcaaaccccagacaccatgtcccagacaccatgtcccttcatccccatatactcttaaaaagtggacacttctcacataaccatatatgtaaaaaactgagcagttattcctcattatgaaatagtcagaatgtttagatgccttaaaaataattctgtagttttatttgtcccacacaaagtgctcactctgcctctgaagtgtccatctaaaacactcccccagtgcacgcgcgcacacacacacacacagagcaacccctctgcctttttttttttttttttccctgaggcagggtctcactctgtcacccaggttggagtgcagtggcatgatcaaggattggtgcagccttgacctccaggctctggtgagcctcccacctcaacctccaaagtagatgggactacaagcgtgcaccaccatgcctgcctaattttttgtatttttataaagatgaggtcttgccatgttgcccaggcaggtcttgaactcctgggctcaagcgatcctcttgcctcagcctcccaagcactgagattacatgtgagaaccaccgtgcctgacctcatgtgcctttttaataaatgattttgatttgctgaagaaagtggattaatttaactcgttacctctagaggcttgattagagtcctggtcagttctcaggaagagtatttcataggtggtaccacgtacttcctgctgactgcactatgccaggggtacatggtcattatccctttcagtgatgctaacattgatcagtggatccatgaagggaacgcctgatcccttttgtaagttgcttcataaaacttccacccaaccctaatggtttcatctattgatggtccttgttagaataaattatcgcactgaggattgcgagtggtgacctttcctttcttccatccctccccctccctctctccctcgttcccttccttcccttcttccctctctcccttccttccttccctcctttcctcctttcctcctttcattctctccctccctccttccctccttctctttttctcttcctctctccccccctccctctgttcctccttcattccatccctccctccctcccctcctctccctccctttttcctccttctctttctcccttcttccctctttctcttcttccatctttctcttcttccctccttccctaattctttccctctgtttctctttccctccttccctctctccatctctccctccttccctccttccctccttccctccttctctccctccctccttccttccttctcttctttccctcccctcttccctccttctcgtcctccctccttccctccttttctccttccctccctccctcctctcctccttctctccctccctacttccctccctcccttcttcctacaggaatctctgtcgcccaggttagagtgcagtggcaggatcatgggtcaccgtaatctcacactcttgagctcaagcaacctgcaaccctcccgccttagccttccaagtagctgggacgggaggtgtgtgccaccatgcccagctaatttctaataagtttttgtagagatgggatctcactatgttgcccaggctggtctcccactcctgtcctcaagcaatcctcctgtctcgacctcccaaagctgcaagtggtgactttctaatgtgaacattctagccagatatatcagctgggatgcttttgtgtgagggtctatggtcccagctacttgggaggctgaggtgggagactctcttgagcccaagagttggagaccagcctgggcgagaccccatctctaaaaaaaaaaagttttccctcatcaactatggctatttggttactctaaaattcagtgcacacccaaaaaaagggagagtaaatgcttcgttcttttctccaattgttgatttctagagtgaaaaaggagaattagggttgaccaatgtattggttgtttttactatttctgttgttttttttttctttttttgagacagggtctcaatgtcgcccagctggagtgcagtggtgcaatcttagctcactgcaacctccacctcccaagctcaagtgatcctccaacctcaacctggagagtagctgggactacaggtgcacgccaccatgccaagctggattttgtattttgtagagacagcatttcaccgtgttgcccaggctggtctcgaactcctgagctcaagctatctgcctgcctcggcctgaactcatgaaattgtttctgtgtttttattttggaaattttcaagtgcattacaaagtagagaggctacggcctcagcctcaatcattatcaatatccgaccagccgtgtttcagccctacccttactccctgtcctgtctccaccacggatgattttaaataaatccctggcaatatgttattgtatccacaaatacttctatatgtatctctcaaagatacagacctcttactctttttttttttttttttttggagtctcactctgtcaccaggctggagtgcagtggcgtgatctctgctcactgcaacctccacctctcgagttcaagtgattctcctgcctcagcctcccgagtgactgggattacaggcgcgtgccaccatgcccagctaattttttgtatttttagtggagacggggtttcaccgtattggccaggatggtcgcgatctcctgacccggcctcccaaagtgctgggattacaggcatgagccatcgtgcccagtcctcttattctctttaacataaccacattgccacaatcacaccaaaaagttaacttcttttttaaattcgtttttattttttaaatgaaaaaatatatgtaaacaaatttagatgggtgtctcactatatcgcacaggctggtctcgaagttttgggctcgagcagtctgcccacctcggcctcccaaagtgctaggattacaggcatgagccaccatgcctggccagtcatttattaatatattcaaatagtcagtgttcacatttccctagttatctcataaatgtttgtaacagtaacctgtgggtttttatatgttccatatgtttcactcaattgcattcatccttcctttttatgatcaaattgtcccatctttggcagtagagccatggtgacatgtgtgtcctttgacatgtccccatcagtttttttttttttaagattaaaaaagcctctttattcaggacaatcctaacattactatttacctcaagcaactcttcactttatcaataaaattcactctacaaaataattttcctaaagaacaaaatggtaaagagaaggacatatcaacaatactacttactacattcatcaagtgatagagagagagattgaaattcaagcatatttatttacttatttactctacatctaattaccttttataccagtggtttgtaacctcacggaaattctcccagaagaatgtccatacacacaaattatgcacaggttctcaaaactctcttggaacctaatcttggatttcattttcaaaataagtgacaatttccaaacattattttttctttttttcttttttttttttttgagatggagtctccctctgtcacccaggctggagtgcagtggcacgatctcggctcactgcaacctccgcctcccaggtttaagcaattctcctgtctcagcctcctgagtagctgggattacaggtgcgcaccaccacacacagctaatttttgtatttttagtagagacagggtttcaccatattggttaggctgatctcgaactcctgacctcaggtgatccacctgcctcagcctcccaaagtgctgggattacaggtgtaagccaccacacccagcccccaaaattatttttttcaggtacagtctagaaattccctcatctcataatcttcagcttatttttcttttttttgagacagagttttgccctgtcgcccaggctagagctcagtggcgcaatctcggctcactgcaagctccgcctcccgggttcacaccattctcctgcctcagcctcccaatcttcagcttattttttaaacgaattaactttaccagttaaaaaccttcctagaatattaatgagcacagatatattatgctgaaacccgttttattaaacagctttgagtattggtttctacatttaaggtttaagaaaaaataggaagtttaataaaattgaattgatactgaagtcattttccattctttcaagaaacatgactaaaaagtatgttaatatcttaaaagggaaggattttactgcagaaacgctatcccaggagcacagcaaactctacacgcatgaagatcatgtggcagtttcatgaatatcactcccataatctgcatggtggcagtgatgtagtttccattacactcttttgtcttgttattgaaatatttaagtaatattttaataacattttcttgaaatataattcacagactgtaaaattcaccctttaatgtgtctaattcagtactttttaatgtattcacagagttgtacaaccatcactactgtctaattgcacaacattttcaccccaaaaaggaagcccgtgccctttagcagtccccattagcctttgaggctttttcacccctccacaagatttccaggtgtatcttgtatatgtcaggcacaagaccttgaatcagctatgcagttcctttagtgagccctgcagatgaagacggggatttagaaaccacaatttgggcactggtggtgcttattcactcagttgtcattacatttaggtctttgtaatgaacagaaccagcatatataacttttttttttttttgagacagagtctcactctgtcgccaagctggcatgcagtggcgcgatctcggctcactgcaaccgtgcaaccactgcctctcaggttcaagcaattctcatgccccagcctcccaagtagcagggaccacaggcatgtgccaccatgcctagctaatttttgtatttttagtagagacgaggtttcaccatgttgaccaggctggtctcaactcttggcctcaagagatccaccagccttggcttcctaaagtgctgagattacaggcgtgagccaccatgcctggcctgtaatgattttctttttatggttatgtcactaatttgataaatagttaaatttattcattttggtttgttttctagttttgatatcattacttttgtctttttgacataattttctatgggattaactttgtctttttgacatagtttccattttgaatatgtggaatatttacataattttcaaagtcaaaaatataaccatatttattcagaaaaatctgaataaacttatgtttctgtgtctattatattctctctcaccataggtaacttttacatttctggttcattttccagttttttgggttttttctttttttttgcagatagaagggtgtgtgtttattccatttcttacaaaatactatcataatatatatattttttgataccttgctttttcacctgacaataaattcctggagattgctctatatcaatgtgtagagattttctgattgtttttatggctgcgtagtattccattgtgtggatataccctagtttgttcaaccagttatgtatgtgcatgcgtgtgtgtctgtgtatataactttgtgcatacatctttttgcattttgctggtgtatctttgggacagattcctagggctactggattaaagggtaagcaaatctgtaattttaaaaacgtattgcaaattttttcaccataaaagtgacccattttgcactcctatgagcaatctatgagaatgtcggcttcctcacagccttgtcaaaagaatatattgtaaaacttttgaatttttttcaacatagtaggtgagaaatggtatctcagcatcatttttagtgtgtatttctgggcggggtggaggggggagttgttttgtttttcagaaatgaggtctcactattgcccaggctggtctcaaactcctgggctcaagcaatccttttgcctcggcctcccagagggctgggattacaggtgtgaggcaccacactcagccatgtatttcttttattagtgaggttgaacattttttgaaatgtttcaggtctttttttttttaatgttctctgtcagttatctatcgctgtgtaacaaattaacctagcacttaatggcttaaagcaacacccaattattatctcacagcttctatggatcaggagtttaggcacagcttctgcttcacattgtctcacatagctgcagtcaaaatgccaagctgctctgtggtctcatctgaaggctcagagggggagaatccactccattgcttgcacacattgttgctggcaggatttattcacttagttcctcgcaagcgatggaacagattcttgtttcttgccatacagggatctccacagaacttctcccagcatggcagctggcttcaccagagcagtaagagagatggccagagagagtgctggcaaggaggagagtactaacaagaaggaagggacagggtctcactgtgtcatgggtcactgcagcctcaatctcccagggctcaagcaatcctcccagctcagcctcccaaagagctgagactacaggcccatagaaccatgcccagctaattaaaaaaattttgtgtgtgtgtggagacagggtctcactttgttgtccatactggtcttgagctcctgggctcaagcaattctgcctcagcttcccaaagtgctgggattataggcataagccactacacctggcccgcagtcattttgtaacctaaccacagaagtcatctcccatcattcttgctgctttctattcattagaagtgagtggctaaaccagcctgcgctcgatgagaaggaatgaaggatgtgaatgtgaggaaggtgaagacctctgagggccatgtcacaagctgcctgctacaatacctactcatgtttctaacccattcctctattgagttgttggtatgcttgatttttaagagctcttaatatattatagagccctttgtgctctcagttacaaatacttttcttaatttatcttttgttttgcactttgtttatggatcttttgttatgcagatttaagcggggtgggggggcgggtaaaggttacctactgtaaaatttaccaatctttattttattgcttctggtatttgaatcatagtttaagtgtacagttggccctccatatctgtgggttccccatccatgcatgcaaccaaccatggatcaaaaatatttgaggatggatgtggtggttcacgcctgtaatcccagcactttggaaggccaaggcgggcaggtcacttgaggccaggaattcgagaccggcctggccaacatggtgaaacctcatctctactaaaaatacaaaaattagctgggcatggtggcacacacctataatcccagctgctcaggagaatgaggcaggagaatcccttgaacctgggaggcagaggttgtggtgaactgagatcacaccactgtactctagcctgggtaacagagtgaaactcttgtctccaaaaaacaaaaattgaaaaataattgcatctatactgaacatgtatagacttatttttcttgtcattatttcctgaaaaatacattataacaactatttacatagcatttacattatattaggtattataagtaatctagagatggtttcatctatacagaaggatgtgcctaagttatatgtaaatattacaccattttacatcagggatttgacatctgcagattttggtatccaggggaggtcctggaacaaatcccctacggatactgaggggtgactgttttttccactctcatgtgataaaggtatttcttcatttttttcccccattacttgaatggttttgtttttactgtattcatttggaatttgtcttgacatacaggataaatcttttttttttttttttttttttttgagacagtcccactctgtcacccaggctggagtgcagtggcgcaatctcagctcactgcaacctctctctcccgggttcaagtgattctcctgcctcagcctcccaagtacctgggactacaggcgtgcaccaccatgcctggctaatttttatgtttttggtagagatagggttttgccttgttggccaggctggcctcaaactcctagcctcaggtgatccacccacctcggcctcccaaagtgctaggattacagatgtgagccactgagatgctatcttcttcatacactaaatttccatagatattgggctaatttctggacattctgtttgactcctttagcgctctttgtatattcatgtacccatagtacagtgttttaagttttagagactgtgttagggttctccagagagacagaaccaataaaagatatacataccaacagatatgtgggaagagatttattaggggaattggctcacatggttatacaggccgtctgcaagctggagaccttgggatgtcagtagcgtgactgcccaagatcagaagcttcagaactaggttaagctgtaactctcagtccaagaccaaaggctgacataagtggggtggggtgctgatgtaaatctcggagtccaaaggccagaaaacctgcagttctgatgtttaagggcaggggaagaagggtgtcccacacaggagagacagaaggagagagacagagacagagagacacagaaacaatttgtttttcctctgtcttttttgttctgtttggggccccagctgattggatggtacctgcccacatagatctttcctacccagtctgctgactcacacgccagtctctctggaaacatcttcaaagacactcagaaataatgctttaccaactctctatgtattcctcagtgcagttgagttgacacctaaaattagctatcacagagacttattttaaaataatatgtatgttatttggtatcttattcccgctccacccctaggattttcttaattatttctgcttatttttccatataaattttgtaatcaacttgtcttgctccagtctggggggaaaatctcttaatgtttttattaggatcgtgtcaagtttatatgttaacttagggataatttactcatttataatattgagtctccttattggagagcacggtacatctggtacatggtacatagtatatcttttcctttgttcaagttcagttttgcactttgaggaatgtttagagcagttttagttgcatggggttgtttccagtatggtgcaattatgaataaagctactatgtacgtttgcatttaggtttatgcatgaatgcaggtttccatttctcttggttaggtgtcttacagtaggattgctggggggtatgttaaatctaattcattcttagacttttaacccatgcagagtgatactttttccactcagcatttatagttgtcagggaagcattaaatatttcttctcttttgttgtactaatacaacatgtagttttgttttgtaacttgtattaggagcgtaggtcttgtttatgcaaatgtaggcaactgctcccggggtcccacgcagcaggtatggctttcatgagctgtggctcaagtttctcccagacttgaagggtggattaactagctcccagagtaacttctaaggcccttagttgattacaacccaaaatcatacttaaggccaactccggggacagataactctagctcattcactcgctgatgaattccttcaccaaacattaatgtctttcacatgagagatgccaccaagatctgtggcataacatattaagagacacacaccatctactgcgcatcctgattgcccacagctcttgtttgaacacaggtgtttaaaaggcctcaatcaggctgggcaccggtggctcacgcctgtaatcctagcccttttggagactgaggcaggtggattgcctgggctcaggagttcaagaccagcctgggcaacatggcgaaaccccgtctctactaaaaatatgaaaaattagctgggcatggtggtgggcacctgtaatcccagctactggggaggctgaggcaggagaatcacttgaacccgggaggcggaggctgcagtgagccgagatcatgccactgcactccagcctaggcgacagaaaaaaaaaaaagaaaaagaaaataaaagaaatataccatgtgtgcaggtgctctctgctctgacacagaagtgctccctgagataagccctccaaaagttctgggattacaggcataagccactgcacccggcctccaacatgaattttctaaggacaatctagctaattagatttctgcttttccttagtttacctgctactcagcttgattggcattgtaggtagaaagagctgcaaggcattctgggatgtgagtggccgccccactgggaagaaacaagaaggcccggccccggtagaacaaggactgggaggtgtggctgaggtcacaaaggttggcttctgttgagctagcatagttctgtggggtcactctctttaccccacaaaccaggcctgcaactgggccagaaaaggagcctcaggaaagaagccagggcaagaagctcagtcactgctatagggaggcaagatgaaggccatgaaatgggcctccatggctgccgggctgattccagaccttactggcaatgcatagagctgccactcagagtccccccgtactggaactcatttcccatttcacagcagcagcccttgctcttccttaagaagcgtgacccttcatacccttggcgggaattggtatgaacatcaccctcagatccgaagccatatgcattaggctgttcttgcattgctacaaagaaaatacctgagactgggtagtttataaagaaaagaggtttaattggctcatggttctgcaggctgtacaggaaaaatggtgtcggcatttgcttggcttctggggaggcctcagggaggttttattcatagcagaaagtgaaggaggagcaggcagctcacatggtgaaagcaggagcaagcgagaaaaagagtgtggcgtggggggcggtgcacacacttttaaaccaccggatcatatgtgaactcagagcgacagctcactcatcaccaaggggacggcccaagccattcataagggatctgcccccatgatctgaactcctcccaccaggccccacctccaatattggggattacatttccataggagatttgggcaggaacaaatattgaaactatatcaccaactaaatatagctggagttttcagtaagtctgagttgggaatttgcatttctggcaagtccccggtgaatgctgacactcttggtgcagggaccagctgctgggaaacattcctaacgagcgtcttcctgcttctacctaaagcgcactcattttgaacacgtggatgaattattagtaatttaaaaattaactcatcagtgattactttgctataaatattttatttcaagactgctacaaagaaggcattacattcttgctccttcccatgtcttagtgttctgacagcactggttgttttcaatatcacctctttacctcccacattaatgacagcatgtcaacattttcaggcacgggacaaactgacttctcatagggtgtgatatttgattttcaagtgggaaaattgagcataaattcactccttcaaggaaacttttttttttttttctgagatagtgtctgtcactcaggctggagtgcagtggtgcaatcctggttcactgcaacctctgccccctgggctcaagcaatcctcccacctcagcctccagaggagctgggaccacaggcgcacaccacaacgtctggctaattttttatattgttgcccaggctggtctcgaactcctgagcttaagcctcggcctcccaaagtgctgggattacaggccttgtggcacctggcctcaaagaaactttttaattgacacttaatagcaagcaacaacagattacaattaggccagtctgtggcaggaaaaacaaagaaaggggagaggagagaaagaaactcaatttctggaagacaagcaaaacaattgcttgtctccattctgcattggaaacattctccattggaaacagggagagcaaaccaacagtacttgctaatagatttgatgacgggggagggtagaggaaagtatatcagatcttgttttcttttttaagagacaatgaagcagaagatataaaaagaaaaacaatttttttgttccttgttctgttctcgtaattatttttgcaagttttgtaagttcctgtttttcccttctgtgtggcacggcaaggtcacaagatatgttttaagttgcaaggcctgtcactgtttaacaaactgcctttgttctgcttctgtaagcttgcttgcctgccctacaggttttgtgctatcaaactggccaacccccttctggatgcatgtataaaagtgaagccctgtctttgttcggggctcagcctttggatgttaatctgctgggccggtgcgcacctaataaatcctcctgtcccacccattggtctctactgtcccttaattcctgcaataacaaggtctcactttgttgcccaagctggagtgcagtggcacagtaatagctcactgcaccctctaccttgagggcccaagcatcctcccacctcagcctctggagtagctcgggctacagcgtacaccaccacagctggctgattttttggttttttgtagagacagggtttccctttgttgcgcaggctggtcctgaactgctgggctaaagtgatcctcctgcctcagcctcccaaagtgctgggattacaggcgtgagccactgcacctggctggaaacactcttaaaaaagcttgaggtggccgggcgtggtggctcacacctgtaatcccagcactttgggaggccaaggcgggcagatcatgaggtcaggagatcaagaccatcctggctaacatggtgaaaccccgtctctactagaaatacaaaaaataagctgggcgtggtggcgggcacctgtagtcccagctactcaggaggctgaggcaggagaatggcaagaacccaggaggcagagcttgcagtgagccgagattgcaccaccgcactccagcctgggcaacagagcgagaccccatctcaaaaaaaaaaaaaaaaaaaaaagtttgaggttagtggtccatttttatttctattttattttttaattgacaaataataattgtacatattcttggggtgcatagtgatatgtcaatacatagaatgtacagcaatcagatcagggtgagtagtgtatccgtaatctcaaacatttatcatttctttgtgttgaaaacattcaatatcctccttttagctatatatttctaattttaatttcattttctaattattttatttatttatttattttagagacagtgtctcactgtcgcccaggctgagtgctgtggcacaatcacaattcatagcagcctcaaattcctgggcgcatgtaatcctcctgcctcagtctcttgaattcagctattcaaaactatttattatttttaactctagtcatctaacagttggtatagaacactagaatttatttctccaatctagctgtcattttgtatcctttaacgaaatttaaatggaaagttagagaaaaccaactcaaactagcttaaaaaataaatcaggctgtccaagtagtagtttcagaaacaggtggttccacagatctgatatactttcctgtaccctccccccatcgtcaaatctattagcaaatactgttggttttctctccgtcaggtagcttggacccatccacttcacctagcaaaccaagcttccatcatttctcagcagaaaaccaaaatgagatggtttctccactttcactgttgcctttctgattggtccatttttaaacaaattctactttaccaaaagtcacttttcttgaaaagtccgggtatgaaggaaaaggtgttggttttgcagccagtgtgttggcataaagctgtgtggtgatcaaaagaaggcctccagtggaaaggagaaatccacccatccagccgctggacatggcattgccgcatccccccggggcttgttgggtgggaactctgagctttagaacctccacacggtaatatgggcaacgtaggacacggacgctcaagtagtgagtccggccagaaaaaccagagctcccccagcaatgttgacacttctctcccaagaacttcctcctcggccccagcatctcagccacatcagtcccaggatgaccgccacaagcccgagagaacccacagccccggccacgcacgtgaggacacgagccacctggagtttggcagccaggttctttgggctggcacacactggcacctgtgtctcgagtcacacatgcttcccaaaggcccagcatgtacttctcactctcgagtaaacccgaggagaaagtcggccactgaggcatgcacacacaggccactgaggcatgcacttggcaggccactgaggcatgccagggaacagacgcggccagccacagaggccaagagccccacattttgaatcagccagatcgccctgcttttcatcctgctctccaggcccaagttattctggggaaactgtctctcggtcacaacaggactggctcgttagattgacatcttgacggattcgccgcagttcgtgccagctggtctgcaaccattagttcagtcctttgtcaaccaaccagaatgcagctgcttattaaatcgggttacttggtaactgggctgctattgttcacccttaactaacgcagatgaatacctaccatcaaaataggcccaatagaaaacctgctgccaatacagagccaggtgggagaaccagcagattgagacaggtatgcaggcttgggagaattcttgctggttataaaaggcatgcattttagcaattttatttccaaaaggtaaacagtttgggatacggagttattagacattagagtcatctatcacggtttgtttttttttttccttttctttttttctttgagacagagtctcgctctgtcacccaggctggattgcagtggtgccatctcggctcactgcaatctctgcctcctgggttcaagcaactctccctgcctcagcctcccgaatagcttggattacaggcacacaccaccacacccggctattttttgtatttttaatagagattgggttcagccatgttggccaggctggtcttgaacttctgacctcaggtgatccgcctgcctcggcctcccaaagtgctgggattacaggcatgagccactgcgcctggcctgatcaagtttttaaaaagagtatttcttcacttttaattattttaaattctctttagtattgtctcttccagggtttggtatctgtatctggttccatcattcctaaacctaccttcagagaaaacatctaattaattacccacaccttccattaaaaccagagattgggatcattttgaattagaagagacagacccttatgatcccacaattgtgttccttggtttttatccaaatgagctgagaattcacgtccacagaaaaacctgcgcacagatgattatagcagctttactcataattgccaaaacttggaagtaacaaagatgtcctttggtagatgagtggataaacaatgtgatacattaagacaattggatatttttcagcacaaaaagaaatgagctatcaagccatgacaagacatggaggaaccctaaatgcatatttcccagtgaaagaagcccatctgaaaggctacggacggtaagagttcaacagtgtgaccctctggaaacggcaaaactatggagacagtaaaacaatcggtggtttccaggggctagagaagaaggaaagatgaagaggggattgcagaggatttttagggcagtgaaactatctgtatgctaccataatgatgaacacatatcattgtacgtttgtccaaatccatagaatgtacaacaccaaggatgaaccctaatgtcaactatggattctggtgacgatgacatgttgatgaaagtgccctgagggattgttcacagacctacaccaggaaaagaagtttctgctcatgaatgccactctggctctcaacctgtgcatgagtgagatccccacagacgggagctcacagttctctttctgcccccattaacctggaaggaatctggcctcaagaggtgggcaagattggatcaggcaccagaggccttggcggtcattcttgtcaggcagccttgccaagctggaggcagaggctggtgacaggtgggacagcaattccaaggagaggtggtgatggcccaaatcaggggcatggcagagccgtggggagagaggaagagagatggaggggcagcagtgccgggatgtgggggttactgggaaacagaggacaagcaaatgcggtgaccggaggggacacctgcacttctccgttgggcaacttcccgtgctcacggaggcctctcatgttgttcgtaagctactgaggcagtgtgtgacgagatgctgaaaccttggctggtaaatgcacttcaggccttcaacttcctggctactacagccgaggtggggtttgggtagctgtgagtaagccagatgcgacggaccgtgtagtgatagagtcctcactgaaaggtccagaagaaatcccataaggtcatcaaacccaggctctgaatggagttccactaggacacagtgggcccgtggatggtaactgtcacatccacaaggctattccttgtggcacaatcttcgtcataggatcattgaaacagctgaacttggtgggaagaaatcgggaaacagcttttgttttcctaccactaccttgcaaacacgatgtggatgaaccttgaaaacatgatgtcgagtgaaaaaagtcagacacaaaaggccacaaattgtacaattccatttatatgaaatgtccagagtagagaaattcatagaaacagaaagtagatgaatggtgggcaggggctgggaagaggggaatggggagtgactgctcatgggcacaggggtcgttttaggagggacaaaaatgttctgaaattgatggtgacaatggtcgcacaaccttgtgaatgtactaaaaaccactgcattgtatgctttacacaggcgagttgtacagtatgtggattatacctcagtaaaactggtatatatatatatatatataaagagagaaagagcgagagagttccacattaatttccgataagcaccctttgtaaactaaaaaaacaaaagacacttcattcaatgctgtctatcttaaacgaacacttaaatatatctttaacgatgaaggattagtacagttttttctaaccttggagtggtgggggccatttcaggatcgcctgtggggccttgttcaaatccaccctccccccagcaaagcacccccttcactgaccctggtcttcccacacttgtgaatcactacattagaagaattccctgaaaatagggaaccagacttgaaaacttgtcattaccaaagttacgtaagattgctctggaagttccttttttttttttttttttttttttttttgagacggagtctcagtctgttgcccaggctagaatgcaatggcgtgatcttggctcactgcagcctctgcctcccaggttcaagcgattctcctgcctcagcctcctgaatagctgggattacaggcgtacaccaccacgcccagctagattgttctggaagttctagccagggtgctgtaagtcaggagacagagaaaagaggtataattatcctagaagggtgtgtgaatctttgttcagctaagttgaccctatacctaaaaaaagtccaagaaaagttattacactacaacagaaagttcaattatatagctggatactaaatacacaaacatcaacaatcttttcgtgttcctacacaatgagccagtttgaaattagaattgaaacagagtactttcacacaaaaaagcaataaactcccaaatatctagcaataagcttaatatgaaatgtgcaagaccctgtatgttgcaaactgctcaaccttagtaagagccaaaagaagccatggagacatgtccccagtcccagatggggaaattaaattttgcaaagttgttccaccttctgagattaatttgttggcttaatgtgatgctaagcaaaatgtttatgaaaatcggcaaatgcaaaaaatgagcaaaacctgcatgtattaagattgttacagtttattaagtgtaaagtttatatccaaagaaaaccagtgtaaacacatatcaatctctagttagtggcatacttgctgaaaacttagggggatgtgtactgatgtctgcaatttactatgaaatgtatgaaagaataagatggattgatggatggatagagggatgaacaaatgaataggtacatgaaaaagactatagtaatctgcctcttatcagagcagaaaaatgaataaaaagaaaaaggaaaatacagtagaatgttaatgagagaatctgggtggtatttgagttgttcgctaaaattttttcaaccttgtttaatatgggaaagtttttggctggacacagtggctcacgcctgtaatcccaacactttgggaggctgaggcgggaggatcgatggagcccaggagttcaagaccagcctgggcaacataaggagaccttgtttctactaaaaatttttacaaaaattagttggatgtggtgttgcatgcctgtggtcccaaatactcaagaagctgagggaggagggtctattgagccccggagttaacggctgcaaggagctatgatcacgccacttcactccagcctgagtgaaaaagtgagaccctgtctcaaaaaaaaaaaaggttcataataaaatgggaaaaatacagagcaaagaacaacaaaaaccaaaatgcatataaaagaagattccagcttgaaaaatatgagctggataaagatggggtggaaatgggctaaaatgttaactatgatgaaattataggtgatttttatttacttgttcatactccatgcattgattgagctttttctttctttttaaaaacaatatccaagtactacttttattttaatttttttaaacagggtctcactctgtcacccaggctggagtgcagtggtgtgatctcggctcactatagcctcagcctcccgagtagctgagactacagtcatgtgccaccatgcccggctaatagtttatttttttttttgcagagatgggggtctcactttgttgtccatgctggtctcgaactcctgcttaagagaccttcctgccttggcctcccaaagtgttggaattacaggtgtgagccattgtccctggatcaggagttgcttcttatggatgagcaaagaaagtagtttcttaagacacaatctcctcctggtgaagatgttgtgaacattattgaaatgacaacaaaagattagaatattccataaacttagttgataaattagtgggattcttccatttctccaccaggtgacagcataagcacgtcaaaatagcaaaaattgtctcagaacacagtatttggtctgacattgaacattactgctgttaattgactaggtgtttattttgacatgttacttgcacaaaggattagaatattatgtcaacctagttgataaaccagtaacagggcttgaaaagattgactctacttttgaaagaagttctaatgtgagtaaaatgctatcaaaaagcatcgcatgctacagagaaatcttttgtgaaaggtagagccaattgatgcagcaaacttccttgctgtgttattttaagaaattgccatagccaacccagccttcagcaatcaccaccctgatcagtcagcagccagcgacataaaggcaagaccctccaccagcaaaatgattacaactcactaaatgctcacatgatccttagcattttttagcaataaagtgttttttgttttttgagactaggtctcactctcgcccagactcctggagtgcagtggcactatcacggctcactgaagcctcaaccacccgggcgcaagcgatcctcccacctcagcctccagaatagttgggactacaggtgtgcaccaccacgcctggctaatttttgtattttttgtagagatggggtattgccatgttgtccaggctggtcttgaattcctgagctcaagcaatcctcccgcctaggcctcccaaagtggcgggatcacaggcatgagccacctcgcccggcctgcaatatagtaattttaatttaggatactacatttttttaaggcataatactattgcacactgaagactacaatatagagtaaacataatgtttatatgcattggaaaaccaaaaaaaatatgcgactcaggttatagagatatttgcattattttggtggtctggaactgaacctgcaatatatccaaggtatgtctgtgggtgtgtgtgtgtgtgtgtgtgtatgtgtgtgtgtgtgtgtgagatgttcatggcaacatttatttttaatagaaaagaaaagaactggccaggcgtggtggctctcgcctgtaatcccagcactttgggaggccgaggcaagtggatcacctgaggccgggagttcgagaccagcctgagcaacatggagaaaccccatttctactaaaattacaaaattagccggatgtggtgatgggtgcctgtaatcccagctacttgggaggctgaggcagaagaattgcttgaacccaggaggtggaggttgcggtgagcctgagatggagccattgcactctagcctgggcaacgagagcaaaactctgtctcaaaaaaaaaaaaaaaaaaaaaagaaaagaaattaaagcaaccaagatatctgaatatctgaacagggtcaaagggtcaaactactagatatttgtataaatgaagaaacttgattttaggtaaacaaagcaagaatcaagtataagaaccatgtccaagattagcacctaaatagcagaaaagctgactttatactgagagaactattataccctgatttgtgtatctctcctacctaggaactcagaatcttgagtcaatggtaaagtgaaattatgggtaattttttctttctttgtacttttatggattctttgttctatactgagcatgtatgaatttttaataaaagttataaataatgaacacatctggattttataaattactctacattcataaagcattcttctgcaaggtggcagcataagcccttccgagtacagtatttgtcctgaaattgaacactattgctgttcattgctcagttgtttattttgacatgttacttgcacaagcaaattattcattatattgttaatttttatgaaagaattactatatatttattgcaaagttggtatacagaataggataaaactctaaatcacctgttgtggcactactcaggtataaccaagattaacactctgaaattatcttcatgttcacagatgtgtgctggaaacaggaaatgacatgtttttaaagcaaaatgtgccaccccatacaattgtttgctttttaaaatttaaaaaaaaaaaagtttgtggccgggcacggtggctcatgcctgtaatcccaacactttgggaggccgaggtgggcagatcaccttaggccagaagttcgagaccagcctggccaacatggtgaaaccccgtctctactaaaaattcaaaaattaggcgggcatggtggcaggcacctgtaatcccagctactcgggaggctgagtcaggagaatcacttgaacccgggaggcagaggttgcagtgagccgagattgtgccattgcactctggcgggggtgacagagcaagactgtctcaaaaaataaataagtaaataatacataaacaatgattgcgagtacatagtaggtgtatatagtaggaaactactgaagaagtttgaagctagcagaggctagttcatgaagcttaaggaaagaagccgtctccataacataaaagtgcagggtgcagcagcaagtgctccagaagacctagctgagaccacggatgaaggtggccacactcaacaacacattttcaatgtagacgaatgggcttatattggaagaagatgctactaggactttcatacctggagaggcttcacagcttcaaaggacaggctgcctcttgtcaggggctaatgcagctggtgactttaaattgaagccgacactcatttgccgttccaaaaatcctaaggcccttaagaatgatgctaaatctactctgcctgtgctctagaaatggaacaaagcccggatgacagcacgtctgtctagagcatggtttactggtttaccgagtgttttaagcccactgttgagaagtactgctcagaaaaaagattccttttcaaatgctactacccattgacaaggcacctggtcacccaagagctctgagggagagctccagggagattcacattgttttcaggcctgcgagcacaacatgcattctgcagcccatggctccacggatcatctcccctttcaagtcttattgttgaagaagtccatttcataaagctatagccgccatagagagcgattcctctgatgcatctgggccaatccaacggaaaggactcactgttccagatgccactcggaacagtcgtgggttttcgtggagacagctgagcccgcggaaggaggcagctgggacagggccccgcggcaccgcagcgctgtgagagcagagcggctctgactgcgcccgcggctgcagagctaccggcctggggcccttcctcccggaggcgggggtggcggcccaggggcagtgggcgctgagcgagctttggagcagcctggaagtctatggtaggggcgtcctcgtgggtgcgtggtaccagcttcactgtgccctggggaatccgattctctgccctccccttcagctcggcctgcttctgcacgttctggggacgatggtcttgccatagaccccgggagccagatcccctctcacaggacatggagccccggggcgtgaatgccaaaggatacccagcccggcttccatccgtgatttcagctaggtcttctggagaacttgctgcgatctctccgtcagcacttttatgttatggagacggcttctttccttaaacttcatgaactagcctctgctagtttcagacttcttctgtactttcctactatatacacctactatgtacccacgaactttatttatttattcatttatttgacagggatgaatggaagtggaggaaatgaagttaccacttgtagacagcccctaggcccaggggctgggagtgggcggccctggcggggtccagttctgtgtcctccagcagagctgggcccgagactcggccggggcagtccggggaggccagggagccaggctgtcctggctgagccctgctgccgcctcagcggtggccgggagaacaggctgctcactaccatcagcctgcaccagccacccatcgcctcttttccgcacacaaccggcccccgggacaaccagacaccaccggaccgactggctgcagctggcggttctgggcccgctgagttgattcagggctcaaggttcctcctgtgttgagccggggggtttcctgccgggacaggggtgcttgtgtccgccacctcccgggctcacacagcagagagcatcacggggacgtcctcttgggcgcagggtaccagcttcactgtgccctggggaatccgattctctgcacccacctcagctcgccccgcttctgcatgttctttgtacttttatggagtctctgaaatttctatactgcgcatgtattaatttttaataataaaaattacaaataacacatttggattttataaattacgttgcagtcataaagcatgctttccgccaggtgacggtataagcccatcaaatagtttgagagtacaatatttggcctgaaattgaacactactgctgttaattgctcagttgtttattttgacatgttacttgcacaggtgttattcattatattgggtttttttttgaaagaatgactatagatttatttgtaaaattggtatacagaataggagaaaaaaaagtcaccagtcgtggcactactcaggtatagccaaggttaaggatctgacatttatctatttatctttatgtttatctttatgtcgggaaagagaaaaacaacacttttttttttttttttgaggcagagtctcactctgtcgcccaggctggagtgcagtggcgcgatctcggctcactgcaagctccgcctcctgggttcacgccattctcctgcctcagcctcccgagtagctgggactacaggcacccgccaacacgcccggctaattttttgtatttttttagtagagacagggtttcaccgtgttagccaggatagtctcgatctcctgaccttgtgatccgcctgcctcggcctcccaaagtgctgggattacaggcatgagccaccacgcctggccaacaacactgttttttaaaaaatgtgtccccctccatacaattggtttttaaatattttttatttttgtgggtatatagtaggtgtatatatttatggggtacaagagatattttgatacaggcatgcaatgcatgataatcacattgtggtaatgggggaatccatcccctcaagcatttatcatttctttatgttacaagcaatctaattatattccttttgtgtttttttgtttgtttgtttttgtttttgttttttgagacggagtctcactctgccacccaggctggagtgcagtggcagacagatctcggctcactgcaagctccacctccccggttcaagcgattctcctgcctcagtctcccgagcagctgggactacaggcgcacaccaccacaaccagctaatttttatatttttagtagagatggggtttcaccatattggccaggctggtctcaaactcctgacctcatgatccaccctcctcggcctcccaaagtgctgggattacaggtgtgagccaccgcgctcggcctcttttagttatttttaacctacaatacattattgttgactgtagtcaccctgttgtgctatcgaatactggatcttattcattctattaataattatagttttgtacccgttaaccatcccactccccacccactacccttgccaggctctggtaaccatccttctactctctgtgaccatgagttcaattgttttgatttttatctcccacaaataagtgagaacattcaaagtctgtctttctgtacctggcttatttcacttaacaattgttttctaatctatcctttcacattgaatgtatcttgagcgttttcccagtatccctaaattctttgatatggtgatttctaaaaggtgcactgtattccatcctgttgatgcactgtgacttgttgcactgatttaaattagtcatttaggctgttttaactgtccttaaattataaaagatttcccatatataaaatatacagagaagaggctaggtgcctatatacccacaaaaataaaaaaaatttaaaaaccaattgtatggagggggacaaatttttttaaaaaagtgttgtcggctgggcgtggtggctcacgcctgtaatcccaacactttgggaggccgaggtgggcggatcacaaggtcaggagatcgagaccatcctggccaacatggtgaaaccctgtctctactaaaaaaaaaaaaaattagctggctgtggtggcgcgtgcctgtaatcccagctactaaggaggctgaggcaggagaattgcttgaaccagggagttggaggttgcagtgagccgagattgcgccattgcactccagcctagcgacagagcgagactccatctctctctctctacatatatatatatatatatatgtatatatatatatatatatatatgagaatattacagccacccagtgaatcactattccattttaatatgtgttaatttgttgccatctttgcttcagacatttttaagaaacaatagtttacaggtagagttgaatggttcctctatccagttgattcctatccttccatcccacatgtaacctctaatctgaaggttgtgtttatcctccctatccctgatcacagactttaactacaaaagaatgtttcctaaacaatacagtattgttctgagttttaaagtttcacacatactcacaagagcatatcctttattcacttaacattatgatttagagatttacctatgttgacttagacctagctgatttttgctgtcctactatataatttataaatataatatactttactaacacattctcctattgacaaacacttggttgtttccaatcattgggaatcaatgcgcttgggatggggcaggtgcggactagtgccaccagggggcgcgcggagagcaggattgaatggagacgtgcggcgtttggcactcctagcggaggaatggctgagcctctgcagtttccaggatactgccaaatcgcattccataatgcctcggatttcagttctgccagtagcgaatgagatcccatttcctcacattctcgccactactgtggggtatgagactcggctttggcctctctgaggtcaagcatctttttatgcttattggctagcaaggttttgtctttgtgaatttcctacccagagcctttgcttctcatcccgttaggtttgtctttttcccattgatttgtagtttttaaaaatatattcttaatccggagaggatctctacagcaagcacgtggcacgtgcaaactgagtaatttaaggtgagtttaacaaaggggctgtgtggggccctccctatccaccgattccatatccccagattcaatcaaccagggattgaaaaaattcaaacaaaagttccaaaaaatgtttcattggtttgttgttgttgtggtggtggcggtggtggtggtgctgttgatgaggtctcaccatgttgcccaagctggtcttgaactcctggcctcaagcaatccccctgcctcctgcctcaccctcctgcggtccacaatgttccactgtggctgatgtgtactgtgtagttagacctcagacggttgcatctgtgctgaacatacacggaccttttcttgtcattattccccaaacgatacagtacaacaactatttacatagcatctacattgtattaaatagtatacataatctagagatgatttaaagtgtacaggggatgtgcctagcttatatgcaaatattacaccatttcatatcatggacttgagcatccttggatttggggatctgtggggcatccaggaacccatctcccaccaccctgtggatacagagagatggacgactatatttctaaaagcaggagcaggttgggggcaaccaacgagggctgtttcagtacgaatggctggcaacagtgggcgacatctcagcaccccaggcctgaaatggcaaacaaaagtgttgggtgaccattctccctagatgtctcagcattcccacagagtctggttgctgggagcaaagggccctgagaagctctggtcagtgctgattggagagccaccagtcttgggagctacagatagcatctagtaaagatagagatcgtctccctctgcagaggcattcccacatcctaaagccttctctgtcccctcccaggagataagggcttaccttccagcgttacagcccaagagagcttttccctcagcccctgggcagcgagtgacattccaggtcatgtctatggaggggaggacggcaggtcatgaagtcacctcaaggaaagctccagctcccaattcagggctcccctcctgcggcgcaacctgcacagctgcaggcgagcacctggccctctgcgtggcccatgggaatcgggatggtggggaccaacccaggagcttgcagagctactgctttctgctgtgaagaacacacagtctgtgtctctgaaccgagccctgcgatctttggtcagatgtgtgcatggaaccagcacaggctacctcgttccctggcaagaggggacaatctcagccctttcgcagtgtctgacttcataggaatgcgcagaaggtgaagtgaactgtgctaacaggagccacactgcagtggaggcaggcagccagctctgggctgtgttatgaggccagcgtttccatgatgccaaagagaacgggggtttccagggactgggggagggcaaaatggagagacgtgcgtcaaggggtgcaaactttcagtttcaccagatgaatacattccagagatgtcatgtattgcacagtgactataggtgacaatattgcactgtgtacttgaaatttgctaacagggtagatcctaagtgttctcaccacaaagaaaaaaacataactatgggacggggtagatatttaattagcttgattgtgggaattatttcacaatgtacacatatatcaaatcatcaagttgtacaagtaagatataaacataaaatttgtttctaatttaaaaattgtatagtaatttccccacataacggggcatagtggctcacgcccgcaatcccagcactttgggaggctgaggtgggaagatggcttgagcccaggagtttgagaccagactgggcaacatagcaacactccgtctgtacaaaagataagaaaattagctgggcatggtggcgcacatctgtagtcccagctactatggaggctgatgcaggaggattggtctagactgggagattgaggctgcagtgaaccatgatcacactactgtactccagcctgtgcaacagagcaagaccctgtctcgaataaaacaaaacaaaaggaaacaaaaaaaaacaccaaaatcccccatacttactttgtttgcttgcatttagattttgatccatctagagtttatttagttgagatgtgagtttgggatctgtatgagacagagtaaaagctagtctgttttagaaaggagattcataaaattcagtgacttggccgggtgtggtggctcacacctgtaatcctggcacttcaggaggccgaggcaggtggatcacctgaggtcagggattcgaggccagcccggccaacatggtgaaaccctgtccctactaaaaatacaaaaattagccgcgcatcgtggcacatgcctgtaatcccagctactcgggaggcggaggcaggagaatcgcttgaacctgggaggtggaagttgcagtgagccgagatcacaccactgcactccagcctgggtgacagagtgagactccatctcaaaaaataacaataataataataattcagtgacttaaactacaaatctcaccaagtgaccgaggtagacactcgagatcactgggtgacttggttccaaagagtcatttggggattcaggtttcctcttgtttccggtccaccccctaggatgttgtccttgtctctagcttgatggtgggctgcctccatctgtgggtagcagcaagtggcaagaggaaagagagcatgaaggacacacacctctaggatgtcttaagtcctgggccagaatccacacctcttacttctacccacactccatggacaactttaacattatagccacccccaaccacaaatggggccaccaaatgtatccatgtgtcctgcaagaaggggagaatggattccagtgacgatggataccagtccctgccagagaattcagcacagattttctccaggtggctgcagcagagttgctcaatggtttttgtttttgttttgtttttttttttttttttgagacagagtctggctttgtcgcccaggctggagtgcagtggcgcgatctcggctcactgtaacctctgcctcccgggttcaagcaactgtcctgcctcagcctcccaagtagctgggattacaggcacctaccaccatgcccactaatttttgtatttttagtagagatggggtttcaccatgttggccaggatggtctcgatctcttgacctcatgatctgcccgcctcggcctcccaaagtgctgggattacaggcgtgagccaccacacccagccaggtcaatgttattgattgaatcgtgccattttccccacacattcgcacccccactttatcatgtgctaatttcttatgctgtgtactcatttcagttcccttcttcattagcctatctgcttactaatgcttcagtaatgcactttttcaattatgccagctttacagtgtctttcagtatcaaacagaccaagtcctgccttttccacttagtcttcttttttgcaatgttttctgactctttcactgtgttttccatttttaagatagcttatctattggtaaaaatatattgttatactatttgggattttataaaattagtagattaatttggtgatttcctattcaagctcttccctctggtcaagacttcctttgagtcttctagtagtgccttaagttgttgttgttgtttttaaatatagattttgcctatttattaagttcttttttttttttttttttttttttgagacagagtcttgctttgtcacccaggctggagtacagtggtgcaatctcggctcactgcaacctcaacctcccgggttcaagtgattctcctgcctcagcctcctgagtagctgggattacaggcgcctgtcatcatgcccggctaatttttgtacttttagtagagatggggttttgccatgttgtcctagctagtcttgaactcctgacctcaagtgatctgcctgcctcagcctcccaaagtcctgggattacacttgactggagccactgcacccggcctgtttcttaagttcttaaacattagtttatctggttatagagttttaaattatcaggtgttttctttcagctggtggaagatattattcgttgcattcctgcttcttttgttactggtgcgattcttattatcaaatgacttcattttcctttgtaggtgattcttttccctctcttcttgttaaatttttctcttaacttttgtgttttgaagttttaatatgacacgtacaggtgtggatttgtttttgtttatctactctgagaattcatgtctcatcaactccaaaagaatttaaaataactggttactacaaccaagttttagtatttaagttttattatcttaatttctcaggctactaattctcaagtagattacgtttgtttctgccagatactccagggactggactggggcccgtttttccactaatttctcgtctggaatttccatgccacaaggatggtgtgcattcacactccacaactccatgcatggacttgagattctgttttcttctaagattgttttccattccctcccttggagtatctacaagaaacaagcttccttggccaggcacggtggctcacacctgtaatcccagcactttgggaggctgaggagggcggatcaccagaggtcaggagttcgagaccagcctggccaatgtggtgaaacgtcgtctctactaaaaatacaaaaattagccgggcgtggtgacgggtgcctgtaatcccagatactcgggaggctgaggcaggagaattgcttgaactggggaggcggaggttgcagtgagccaagatggcgccagtgcactccagcctgggtgacacagcaagactccatctccaaaaaaaagcttccttgctacttccctgggaggatgagaagtttgcctactcctccctttcatgaaggaggtggtcagtccatgtcccagctttatgcaggagtctcagttccgcctagcttcctgtcttatggggtcaacatcatgtcttttactttcgtgctggaatgaaaacctcagcccttaacagtgagtgtctaagtagggatacaacccccttctgactgaggaaagggatttttcttcctagcttgtctgcgtatttgatattggtattctattttatacagcatgcctatgtgtttggagaaatatggagggtaggggatgtattacccaatctgcccagttgccagaactgcaagttggagtctgtttccaatttttcaatactataaataatgctatgatgaatatccttgcccattaatgtttatgcacatctctggttattttccttggataaatgcctaggaatggtcaaagagtacgaacatttgtaaggtgtttgatatatatgtgaggccccattgccagccctcaaaaacgcaccacttcacattccctggaattcctgctttccggtgcccttgccaacatttggaacctttaaaaaaaaaatcaccatttagttagatttaaaaaatactgtgaaaaaaagcatagtgtgaaaacaatatttttatgtttataactagttagaaaaaaatcaagagttgggcacagtggcatgcgcctgtagtcccagctactcaggaggctgaggtgggagaatcacttgagtccaggagtttatggccagcctgggcaaccataaatagtgagatgctgtctcaaaaaagacagagagaggcgggacacggtggctcacgcctgtaatcccagcactttgggaggccgaggcgggcagatcacgaggtcaggagatcaagaccattctggctaacacggtgaaaccccgtctctactaaaaaatacaaaaaaaaaaaaaaaaaaaaaaaaaaaaaagccgggcgtggtggcgggcgcctgtagtcccagctactcgggaggctgaggtaggagaatggtgtgaacctgggaggtggagcttgcagtgagccaagattgcgccactgcactccagcctgggcgacagagcgagactccacctcaaaacaaaacaaaacaaacaaacaaaggtgaaaagaaaagagagagggaggaaggaaggaaggaaggcaggcaggtgggcaggtgggcacggtggctcatgcctataatcccagcactttgggaggctgaggcaggagggtcatgaggtcaggagttcaagaccagccttgccaagatgtgaaaccccgtctctactaaaaaaaatccaaaaaattaaccaggtgtggtggtgggtgcctgtaatcccagctactcaggaggctgaggcagagaattgcttgaacccgggaggtggaggttgtagtgagccaagatcatgccactgcacttcagcctgggcgacagagcgagactccgtttcaaaaacatacacacacacacacatgcgcacacacataaaataaggctgagtatagtggcttacacctgtaatccaaaaactgtgggaggccgaagtgggaggactgcttgagcccaggagttcaaaaccagcttggatgacaaagtgagatcctgtctctacaaaaaattagccaggcatgatggcacgtgcctgtgatcccagctacatgggaggctgaggtgagatgacagcttcatcccaggaggttgaggctgcagtgagccatgtttgtgccactgcactccagcctaggtgacagaacaagaccccatctcaaaaatagaataaaataaaaataaataaatgctactgtgcactctgttgagcataaaactcaagcaacacatcactgaaacagtgattactgttacctgaacttttgtctagattgatgcttctttttattagccccacccatttctccccttcttcatcaatgcttcttcaacttaatgtgcatgggaatcacctgaggagcttgttaaagagcaggttctgattctgaggagcttgttaaagagcagattctgattttgtaggtccagggtgtggcctgagaatactccccgcattttttttttttttttttttttgagactgagtctcgctttgccgccaggctggagtgcagtgacacgatcttggctcactgcaacctctgcatcccaggttcaagcgattctcctgcctcagcctcctaagtagctgggactacaggtgcgtgccaccatgcccagctaatttttgtatttttagtagagacagggtttcaccatgttggccaggatggtctcgatctcttgacctcgtgatccgcctgcctcggcctcccaaagtgctgggattacagatgtgagccactgcgcccggccgagaatccccatttttaatgaggatgctgatggtgctgctctgtggaccacagagaatggttgactcattttgttgttggccacaatcagaccacagtggaattcacccggtcagagctcggtaacttccaaagcacatatggctgcaaacagcattattaggaccttctatcaacacttctagctaaagtgacagagttaaactgatcctttataaggagcataaatcagttggttagtgatgaaatagcttattgagatgacaaccaaatcacacacaaatacacagacacacacacacaaatctataaatgggagagaatgtaaaacaagggcagaaagttagattgagattgtgcaaaaacgaaaacacaagccccttagcaggaaggcaacttgcatcatatcagatcttatcagcttcaagcagactctggagaggtgagtaagctttctgagttagggtggaatttgtctggtaaataatatggtatttcaatatggtttgccattattgacataggattgcaaagataagtttgtaatttttttacacgagcacattcatctggacattgtatgacctttcggaagtgttgatcatagccttcaagagtgttgtgtgtgcacaaaaagggatttattcaggtttacaaatttcacagtcaatttatttgagttacgagttctaatgcctagttttcctttaaccttctaagttcagtctagaaatcttattattctcttttctttttaaattctattttaagtccagcaaataatagcaaccacttttaagaggcctttggaaaatacttgaccctatttacaaatttaaacaccttcatgcattttaaaatatatttaaaacttgtaacagactacactcaattcccttcttaattgcttcagttgtctcaataaacaaatacattcccaagtttacaaataactcttttaaatttaatgaattaaattgacatggtgaaacttaagttctcttagaatgttccaacactgtatataatttagttttcatgagcctccagtcagtgacaagaaaaaaaatagttttcaactaagatcacaagattactcaattatacattttacagtgatttccaaagcttagaaattcttttaaactttatgaatacatggaacatcaaatacgcacagattctttctgcattccgaatatgaatcctacagttttgattctcttaagagttgctgtactttccctaaatcctcctggagctgaaagattcaccctcttacagctgaccgttaccatcctagtgactgagccggtatacacacccaagatttgggctgcaccctgactaaattcttgtcaatgaccctaatggggtacttgaaccctactcataattgctatgtccctgatgacataatttacgggagttgctctcgaggctcctaacccttagttttaagtcacacacgttattgattcttctacatacacctggacatttgtaggctgacagcatagatcacttgagattttgtatttatctggttcttaagatgtgtatttttccctccagctctaaagacctttgcgcttaaaggaatcctaagatagatagataaatgtcctttctatttgctaatgaaggcctttggaatctgtggaatctttctagaggctttaatcagatttgggttttggggaaggattttcttgtaggtggtggtgttttcttccctaaaggcacagcatgtctggtgtctctctttttgtgatgacagcaggaagatatctttttatgaatactccaaataatattcaattttggatacctcaaaaaatggccttgtctgagccgtggtcaccgattttgaggtcatttattgacaagaaggtgtgatgttagcgattaacaagataatcctttattcatttaagaaatatatctggattacctgctctttgcagatagacagtggagaatgaaacatggctcttttcctcctgttgcttcttgcccaggatttctcagccttggtgctattgacgttttaggctggtaagtctttgttgtccagtgccttgaatgaggtttagcagcctataatcagtgtcctctacccactagatgccagcagcaccgcctcttccctctccatagtcttgacaatcaaaaatatctcagatattgccaaatgtctctggggggcaaaatcacctcgttgagaaccactgttctagtcgagtaggggagaagagatattaacaagtaagcacaaatacaaattcagtaggggttattggctcatgcctgtaatcccagcacttttggaggccgaggagggcagatcacctgaggtcaggagtttgagaccagcctggccaacatggtgaaaccccgtctctactaaaactacaaaaattagctgggcgtggtggcgggtgcctataatcccagctacttgggaggctgaggtgggagaatcgcttgaacccaggaggcggagtttgcagtgagccgagattgcgccattgcattccagcccgggtaacagagcaaaaactctgtcaaaaaaaaaaaaaaagagagacatgacgtgctactgtgagaaatcctggtgtcttagtctgttctgtctataataaagtaccatagagtgggtctagccatctttcttttttgtgatgttagcagccagtaatgctcaaagctgagatctagtcaacccttgtaagttctatttgttcattctaactctaatttcatcactcctttaggattatctggaatgcttctataaagagccactttgctcatctgcaagttggatagccagggatccaaggtaaatctgaactttgggcaactcatggccaatgtgggcatttgtggtttgcctctggtctacactggatatggctgctacagtttacggcatgtacttgagaggtccagcatgtcatgcctggggctcctgggtttggtgggatctctgggggctttcatggcaggcttctgtttcctgtgatttcccagcactgattgggaccctgtgaacagagttctatagactctgttccctactgaagcagcagcaggagcctgggggcaaggttccaggcatgttagtttcctagcgccactgtaacaaaggaccacaaactgatggcttaaacctacacaaatggattctctcacagttctggaggccagaagcctggaatgcaggtgtgaggcagggccactctctctccgaaggctccagggtagaatctgttccatgcctctctcccagcttctggtgcttgccagaaatccttggcattcgttgccttgtggcctcattactccaatctctgcctccatttttacatgaccctggtgtctgcgttccttctgccctcccttatgatatgacaccagtcatattagattaaaggcccaccctactccagtatgacctcatcttaagtaactgcatctacaaataccccatttccaaataaagccacatccacatgtacccagggctaggccctcagcgtatcctttttttgggtgggggagcacaattcaacccccagcaccagggacccaagagagtcaagagcagtggaggttcttcctgccaacggggtcatgctgacctcggggaagtacctgggctggcagagaaggcttgggcagcaagtagtttgatttgcagggacagagtcccattctcaaaaacaatctcctctgctgtcactgaaaattgttgtttctttggaattttcaaaggtcacctgactagaagtgaaaggtatggacagagccggcttcaaaggctgctgcctgtgcaattgtacagggtactgtgctccaaagggcttgtgcttattgtagtggtccactgttaccatctggaaattcttgagatttttttttttttggaacaaggggtcctgcgttttcattttgcactgcaaaacgtagagcacaaactatgtagctgaccctgggttgggacatcaggcaggggagacgcatagtaagctaaggcaaaaatcaagctctgttacagtgtggttggcctgcagctggcttcttctccatttctacttctgggccagggaagttgaactgtatattactgtgcaagcctaaagctgagtcacaaacagatccaggctcttcaatgtgcttatcatgcagagcaagtgtgaaagtggcttgtgattacactttgctcagggattgccatagggcttggcacctcttaaatgataaataaacccctcttgattatgaggtgaagtaaggcaaatactacccagatggctctgtgaatcgatattgtaaagtaagtttttgtagatgcctacacccccacaccatcctcttccatggggtgtaatatgatgcttcttaaactaacagccctggggtggacatttcaatgagttcccccgtgatgctgccgctgctggtccacgagccacactgtgagcagaaagagtcctagaaacaggccaggtgcagtggctcacgcctggaatcccagcacattgggaggccaaggtgggcagatctcttgagtccaggagtttgagaccagcctgggcaacatagtgagaccccatttctacaaaaagttagaatattagccgagcatggtggcttgtgcctgtggtctcagctactctggaagctgagcggggaggattgcttgagcccgggagattgaggctgcagtgagccatgtttgcgtcactgcactccagcctaggtgacaaagtgagacactacctgaaaaaaaaaagagagagaaagaaagaaagagtcatagaaacaaagaacaactagttataaagtcaggaggtgtgatggttaatttcatgtgtcaacttgactgggccactgggccacggggtgcccagatatttggtcaaacattactctggttgtgtgtgtgtaagggtgtttctggatgacatccacatttgaattgtagactgccttctcagtgtcggtgggccttgcccaatcagttgaaggcctggctggaccacaaaggctgggtaggagggtgctcttgctgtgtgactgcttgagctggaatgttgggcttttcctgcctctggactcaaactgaaacattggctcctcttggatctcaagcctgctcactttcagactggaactgacaccatcagctctcctggttttcaggttgtcagacttggactggaactgtgccatcatcagctctccagcttgccaactgcagatcctgggatttgtcagcctccataattccatgagccaattctttatgataaatatctctctctgtctgcctctttctctctctctctctctctctctctctgtgtgtgtgtgtgtgtgtgtgagagagagagagagagagagagagagagtttggatatatatatattggagctatttgtctatacatccctgatgaatacaggaggtcagatgggatagctgggctttagtcttagggctgatgcattttagcactggccaggtcataccaggctagttacttacattctctgagccttgttttcccactataaagtttgggcagtataaatgttctcataaattacacatttgagcccaggagtttgagacaagcctgggcaacatagtgagactccttttctacaaatatatatataaaccgggtgtggtggtgcatgcccgtagtcccagctactcaggagactgaggtgggagaatcacttgagcctgggagttggaggctgcagagagccgtgatcgcagcactgcactccagcctggataacagagtgaggccctgtctcaaaaaaataataacaatacattatacatatctcatagggtttttttgacctcagcactggtgtcatttggggcagatcattctctggtgctgggctgttgtgggcactgcaggatgtgtgccagcatctctggccttacccactaaatgccaggaaccccagtctcccagttgtgccaagcaaacatgtctccaggcattgccaaatgtcccctgggggacaccatcacccgcccccccagttgagtcactgattatataacaatcatcttggttacctgtgtccagaaatggttccattcatgttacaagagaggctaattttaatgctagtgtcaccaaatgaaaaacaaagattgctcatttctgagtgagataaattttccttcttgtctctgcaagcctgagacttctgagctgctctgcctggctcataaagcagaggtctgtagttttaaggatctgtttttccaaatacacaggggaccagagctctaatcctaaataagagagaagccagccaggaggaagtatcttgtagtgtgctggctcacggctgctgcctcttcctaaaattatggtgtgcttagaatacattttgaattggccccttcacattttgtggaacagaacccatgggaaggggaggaaaataagtaaaagtgtaaggctggaagaggagacctggagacgaaggaagtgagtggctctgagttttctaagtttgggagagaaattggtctacatttttaaaaaatctgaattttaatcacccaggcacaaatgcaacgtgcttaaagcatgacagccattcactgattccaaggatgatgttgttttgtgatgcgcatccagacacgggaattaagcgctaaaatgaaccaaacgcagactggcaggtttatccacacagtggacgctttgggaataccctgcctgtctttggagtggaagattaggacatgagaaaaacctgaattttcaaaatggacgcatctacacaaatcaaggaagtcccagttgagaaaagtgccccccgtccacacacgaaatctaaacagtgactttttttaatacaagtcaaataagtgtctaaagtttacgtctttacataaagccatgaaataaaacaccaagaaataacctcaccctgtccccattccaactcctgagcctggggagggtccccttagggatctttgcaatttacccttcctttgatgcccctaaaccagcaagacaggaatgaacaagaacaacatctaatctcctccagtgcttgtggatttgcattatttaaatatatgagaaacacccataattgagtaattattctagcatttaaagaatgccaaacaatgaaccatttcttcttcagacctaatccggcccatttccgttttcctcttagcacaatgtgtagaattacccaatgtgtcgcttcctagaacacttgattgtttatacaaggtaggcaagacttctctggcggtgtttatttttctcattttacacttgatgattgtagcctttacagattttccttttctagacgcttatcaagtactgaatgtgtatggatccaattttgcactttcctttttacaaataaagcttatcctttaggcgagggctggggagagaaggcagaatctgatagtaaaaatcttcagactctgtccttgttggagttactccttaaccatcattttaaggaaagtattctgcaagttagagatcagtgcattgtaacagcttcagaaaggggatttcccagagggtctgggaggagaacaaaagcatttgcatctcctttccccagagactaagtggatttttcctgagctgcttttccatgtgaagtcttggtgggaggatggagcactacacaatgttcgtgcttttgctgttggcccggctgtggttttaatgcggaggaaataaagaatgtagaattgtgcattcagttaggactcaagactccttcgccctgcagtgttttgtgtgtgtgtgtggtttttagtccgatgtggaaagccccacttgactgtaagaaagacaggccttattctaacaattcacacacacacacacgcacacacacgcacacacacacacacaaagagagagagagacagagagagagagagagagagagagagatcgatcccaatttatggcaaagctgggaagtcaagagtcccttcacacccctaccaatttctcttcctttccatctccattcacaagtctttagggaccatcagcaaacgcctggggctaacattgcacacaagtggaaaaggactaatggtgtaataaagaggtcttggtcaccccaagcgctggcctcttcctctctggttcagctccttttaggaagacaaatgcaatagccccacttctgttctctcaggcagagagtgtccagaggcagtggctgggcatgtggatgaagttttctcagtgagggtctccaatctctcttctctggcatgctgtgtcacacttcttttgcctctattaatgtgcaaatgaaagtaggaatgcctctagatgttttggtgattaaatgagctcgtatttgctaagtgcttagatgacagtaagtgtgcaggagcctatcttaggtcaggctctttagaaagggtgcctgagacgggggttctcgagtgagcggctgattggaggcatgcttacacgagtaagggaggcgggaccgggcaggggaggagctggcaaagctatgatttccagagaagtacagcctcagcctgatcccatgggggatcccatggggagctctggggtgtcaagggcattcgagtttgtgtcaccaaggcaaggaaactggacggtcagctcctggggctgggtgtaatctctcagacatctgtgttaatgaagggtcatcttcacaatactccaaaagaagggagcccgccccagcatctgctatacaagtaaacaatttcatgacagcagctccatgtgccaaggggcaagagctcagaacttgggaatctgaacatctgagcctcagtttcctcatctgaggcaccttccctttggtctcacaaagcctcccacgagtccccaaattgaggttggcaccctggcttcatttgttgacaagtgacaattgtattacaagggcctatttctatgtttagtccccaagggagtgcaagctgaagcacagactatcctcttccctgcagcatgcctacacgcagcacagtgtctgcgcgtgggaggtccactatttgctgcccgcctgaacgggtagaaatctttcaccttcagtgaagactcctcggcgctggcctctttgagctcctaattggatgcagtttcccccactccttgctctacctgatgcttttttcatcttgcctttccttctgagtcctttgatgtgtggtgtatgtgttctcctctttccactctctctctgcagaagtcggtttcactccaatacgccccagccccattcaaagtactttcgagtgatagatttgtgtccagatttgtgagattctaaaaggaccaggtgacagggagggtggaaatgcagcttcagaacggccatgttgggtggtaaggtaagaaggcagtggcagccccactggcgataaatcatgccaatcggaagggaagatgtcagagcagggacactcagcacttggggcattccctggcacatgcgacatcacaaaatatgtgcttttttgaccctcccactctttcccttggacatgtaataatcacacatgtttaaaaggactcatgcggtggaatttctcacatagaacattcaggtaggggtagatagatacttggggagcaagaaagtttctgtgttgtagtaggaggagggagaggaaagaccttccttggatagttttttggacgtcgctataccttcacaacttcacattcttcttcttcttcttcttctttttttttttttttttttttttttgagacagggtctctgttccatcgcccagcctggagtgcaatcgtgcaaacacggctcactgcagcctcgacctccctggctcaagtgatcctcccacctcagcctcccaaagtgttgggattaaaggtgtgagccaccgagcccggccccacattcttctaattttttttttgttgttgttgagatggagtctcactctgtcgtccaggctggagtgcagtggcgcgatctcagctcactgcaacctcccaggttcaagcagttctcctgcctcagcctcccgagtagctgggattacaggcgtgcgccaccatgcccggctaatttttgtatttttagtagagacggggatttcaccatgctggccaggctcgtctcgaactcctgacctcgtgatccgcccgcctgggcctcccaaagtgctaggattacaagcgtgagccaccgcgcccggcccattcttcttttttaaaacaacctttcccctcataaaagtaatattaccattttacaaaaaattggaaggcaaatcatttttaaaaatcccgccaaaggaatgcaaactcttgtgagcatttcaggacattttcctccagtctcttcccctgtgtatctggatttcaatcaggctctaccagatatttttgtatcactgtaactgtttaaaaatctccctgatactgtcctgcatttcctggcataacgtgttgcggctgtgggtctggggcacgaagtaggtgggagatttagagcaagacacagccccaactctggagcttcagcttccccagctgggagccagtgaaacagaagttcccgtctaggctgaaagttttaggagttgacccggcttcctccccagcaatggtctacttgggtctccgctcaaacgatcagaccccacaaaccggatgaagcgctcagggaaggtcaaggaactcccgcctagtgtgggcccccaggttagcccttctagggctgtcctggcggggacgcaaagtggccacctgcccagctgcccgcttccagaggcgtcctccctgcgccgcccgagaggaccggccgcgggctcccccagctcctcagctccctcggccccgccttcaggggcttttcccaccttcgcgggaccagacgggttgtgtgggagaccgagggcgcagcctcccgccaagtgcgcagagggtctccagacagccagagcccgggagcgggtgaagggagggcactgcccgctctctcgggaattgtttgcgcccgaggagtcaccccaggcaggccgcgcccgcagtccgggtagggcgtcgtcctccccgcccgccttcctctacgcgggggcccgggggcggactgacgcggcggcgcccatcctggcctccatgcggtttcccgaggccggaggaaggtggcggagcgggagggagagagcgaggagcgcgcggagagggaggacggcggagggggaggagcaagcggaggggtgggggtggggtcgaggagccgagcgccgaggaggaccccgagggagactgggggcggagcagccggcgacggagaggcgcggaggacgcggggccgggggaggcggagcagcgggagtgggtggaaaagcagaggcggcgggaggagcgggagcctccgtgggagattcgggaggagcagccggcgtgggtggagccgccggcgtgggaggagccgcggggcctgggtgagaacggggcgggacggccggaggcggggcctgcgaacgccctgcccctgctcgcccgggccgcgccgaggaacgaagatggccgggcgcgccgcgggaacggaggggcggccggcagcggcggcggcggcggcggcggctcccgggctgtgacttcgcgcgcggcggccacccgggctacctgaacggagtgggcggcgcgggcagcggcttgctagggcgggcgggcggacgccggtgcacgggcgccgggcggaggatgcgccaggagcggcgggcggctccccgcggccgcccccgcgccccgggcgccgggccttagtgctggcggaggaggcggcgcgcgcggggcggccgggcggcggcggggcccgcgccgtcatgccttggctgagcggcggccggcggcgacggcggggacagccgcgcgaggccccgcgggagccgccgccttctgcgcagccccagcgggaaccgcgccgccggcgccccccgccgcggtccccacgcccccagctccttccgcgccgccgccgcgggcccgggagagcgccgagctgccgctgcccgccggctgggaggaggcgcgagactacgacggtcgcgtcttttacattgaccacaacacgcgccagacgtcgtggatcgacccccgcgaccggtaagcgggccggctgggggcgccagacccggcgcgggcgctacgacccgggccgccggccggcgccaccgcggatgcgctggggacacgccccgcccagcgcggggccgccgccgagagcccccgggcccgggcagagctcggagcgcctccatccccggaaccaggggactccctggagtgctccggtccaggctacgatcgaggcgcccccatcccttgggcccagggagaggatcggagacaccaggaggccctcggggctgggtgaagatctttggttccgggggtccgggagaggatccaccctcccaataccccgactcccagggctctgaccaagaatggaggtgccccttctccaggcctcgagccctctgagcgccgaggccggccgcctacaggtcccccgccgctgggcggaccctctcattcggttccctcacgtcacccgctgtccggcgcctgggaactgggctcctggaatttcctctcctggggctgacagatggccctcttttcctttctctgcggcagcctcgcccatcccggtcccgggcgtctgcggcccactgccccggccctggttctgcaggtgtccccagccccgcggtggcgagatgagctgtcaccttggatcacaaacgtgcgccccagctttggggtgcgggttccctgtctggcgggttcaggctggtttccatccaaaacctgatgtcagacgggcccttgagggattcccaacccttttggagttggagaagtctgttcccaaactctagttgctctttagcgccttaaaactcgtgagttaaaactgtttgaaatagccttctgtactgcagccagaatgcaatatgattagtcccatatgcttttggaataaacgaaaaacaagaattgtattttaagtttcctttttgtgaaagatatgcatggggtacaaagctgtcttattcacgtataaaaacccaatcaagtaaaaactgattcttgtaaaagcactatcagatttcatttaattaattccatgtaacgaagctcttccttaactttttgctcgattgtctacgggtttcgattgttcaactgcttttacagagatgtattttgtgtggaattgggatttctgtggacatcaagtgtttccacaggttatctgatgtcttgtcctctctagagcaactctccttccagggcctgagtgccaaaaaggaaacaccacaggcttcccagtgatttgaagacttgcaaaggcccagtgtggtgacattgtgcctgcttcctcctacctgcacagggaaggcggcctgcatggcactggcgtctgaaaataaacttttgaggagagaagctgctgaattgtttgaagatttctctgagttcaagcaggggaaaacaaaagaaagcaaaacaaaaagatcgtgattccctaacattctcgctgaacattgcaaacctctgggctcagaaacctatatcaatcctagtacaattttatgggttaaaaagatgcctagttattttgaaaatcaggtgagatcatgttataattttaaccaaaggctagagccccagctgtttgatcaacccttggatggttctggaattggtagaactgcttggaatgcagtgcccttttataccatatgtatgttaaaaacccaaacaactggaaaatgaaccaattaaaatagtgttttgcttagaaaaggctaaggctcactttccaagggtaatataaaacagttgtggttatattggagtggagattcatgctgaaagatatcaatgtgaggattttctttttaatggtgtaacctgtgacaaacgtgaatggaccatacagaaatcagcttggagaatcttgttttccatgtatttcagacacatttcctatattccttttttccagaaatcgatttgttacttttcagacaatcacttaaaggtttttaaaaagtctccgttctgatgctaaaattgtcaattgagtcaacaaaagtggatattttaccttttttttgtaaagtaaaaacgtgtgtacttttatgagacgttgtttttatagtgagtgaaaattcagcaggggacagcttgaacttcagctcccataataccttgcccgaaatatgtatggaatgttcagcaagccacaaacatttaagtggagtcggctgaaggctgtaatagtcattcttcttcctctttcaaaacagaacctggccgagttttataggtggcgggttaccctttaaagttgtaattaacttttattatatgggaagaactgcatgtcagagggcagtgttttctccatgcgcatctgacagttaaaaccctttttgagttgcttttgagtcacacaggaaaatggtattcaagaaatacgaggactttcaccaaacagcttccacatagagacctgacaggagaaaggcaaatacataatagctttttttttctctttaagaaaatgaaattgtggtggaataaatgaatgtagtaggttaagtgaaaattgttgttgactttaaacataatttcatataaactttagtaaaaactgtatagcataaaatatggtccaaggattgtaaacaaaatctcttcttgagttttatagtaattccattcagtgttgtgtttaacatttgatagtgccggctcagagcctgttggtgaaattattgtaactgctttttaaagttacaacaaagaagatacaaggagacgtctttacggatgtggctacagatgtatacacaatctcaatattttaaaaacaattttttagtttgattataagcctacctttggttggctgggcgtggttgctcatgcctgtaatcccagcactttgggaggctgaggtgggtggatcacttgaggtcagttcaagaccagcctggccaacgtggtgaaaccctgtctctactaaaaacacaaaaattagccggacgtagtggtgtgcgcctgtagtcttagctacttgggaggctgaggcagcagaatcacttgaaccctggaggtggaggttgcagtgagccgagatcgcgccactgcacttcagcctgggtgacagagagagactctgtctcaaaaaacaaacgaaaaaacctaccttcactttaaattcactatttctatagattgatactgtacatataattttcatagttagtttactgggaatcatacccaagaacttggttaaaaactacaaagttaggccaggcgtggtggttcatgcctgtaatcccagcactttgggaggcccagggggcaagattgcttgagtccaggagttcgagacgaacctgggcaacatagggagactctgtctctacaaacaaataaaataattacgtgggcggggtagcgtgcgcctatagtcccagctactcaggaggctgaaatgggaggattgcttgagctggggagatccaggctgcagtgagccgtggtcatgccactgcactccagcctgggtgacagagtgagaccttgtctcaaaaaacgaaacaaaaccccacaccaaaaaaaaaaagaaacgaaaaaacaaactacaaagttaacttatttctatggctggtagtttccttacatgagtcttgtgtggtttacattagtggcacactaatatcttaactgaatatattaactcagaataacttgaccaccttatgaaaaggtatttaccattgggcagaaaatatgggaagaacatttttgccccctttgtaaagattcactgtctttgacagttgtgtttacgtgtgtgtcttgcagggttatttgggtattatcctatagatggactgagtgtttgaaacctcatgttccatttcctgtagctcaggtggagttgtacggtactggaaatgccagctctgggcagcttaagtatggtggacgataccatatttgagatcaaagtataaataatcatgcggatggcggaagagcaagatcatgtcatggcataagcttttggggacccatttgttcaccagatgggatttgacctgtgcttcatggaggaattctgtggtatcttaaaagtcttctgaagatgcttttgctttaagaggaaaacaatccatagctctggaatttgctaggttggatccccatttaacagccaaataacatcattgctaccttcttggaacctttatttagttattcagtattaactaataggaggtttactatattcatcccacagagtctatttttggactatataaactgtcctggttgagctttctgataaacaggtaatgatttctccctttttctttttttaaggttatagatagtgtttgtatgaacatgggggagcatcttgtttttaaggctgtaaggggtcagtccctggaagaagcggctcttgcttccatttagatcatcaatcctcattttttggtctaacattttttggtcttttcctttccttccatttatttgtttatttatttattcatttatttattttttaaagaaaagtgaaaggaaaagtaattcatttccaaaaatagctcctggatgtttggaaatctccaagtttccttctccttcctttcactctgatttgggaagtggaaataacacgtatcaccatctctagttaggttctacttcaggagcccatgggtcaggaacatgttcatggtcatctggtgagcctacggtaggcttcttgacttccattccagatccttttgctaatggtgtctatctttcccataaattcaataaaacaaatctgatggaataaaagcaaagttaaattctactgagttcagttatccctgtttaataaagtgaagaaatatttgtggagagtcttggccttctgtgtgcagggacagtatgtggaaaccaagctggtctgggaggtggcacacagacacataaaatgaagataacaatagttgcaaggcatcccaggattgattcagtttctcggataatgatcacttcagagaaaaggtgggctcacttgagcctggggttgtctttttccttgcccatccttctgggtgaggggttctagtgcttttccagcagtagaaaagcaagatcatctataggatgatccactcagtccatctatagggtaatacccacacaaccctggaagacgcacacgtaaacataactgttaaagacagtgaatctttacaaaagaggcaaaagtgttcttcccatattttctgcccaatggtaaataccttttcttttcttttctttttttttttaaatggagtctcactcttgcccaggctggagtacagtggtgcgatctcggcttactgcaacctccccttcttgggttcaggcaattctcctgcctcagccttccaagtagctgggattacaggcgtgtaccaccacacctggctagtttttgtatttttagtagaaacagggtttcgccatgttggccaggctggttttgaactcctgacctcaggtgatccgcctgaggtgaggcccgcctcagcctcccaaagtgctgggattacaggcgtgagccaccgcgtccagccagtaaataccttttcataaagtggtcaaggtactctgagttaatatattcagttaatgtattagtgtgacactaatgtaaaccacacaagactcatgcagggaaactaccagccatagaaatgataagttaactttgtagtttggtttttgtttttttggtgtgggatttttctttcttctttggaaaaaaaagcaagatctgggcaagataaggggaacaggagaaaagtgctggccttgaggaagtgctgggtgtgttcggaataaatgagggaatgagtcaactcgagtgacccagagctgtcatgtaagggaggtaagactcaggccagagcatgtagctcagggtcccacagctttggggctggaagagctaggatcatcttgttcaaattcctttttctacttgacagccacagccaatgggtatgttctgccggctgctagaagggcaagggacttgagctgggtcttctgacccccgtttgggtgctctttccagaatgccacccagctgcccaatccacacaatttttaagcatcctgcctctgttcattcatttattcattcattcaacaactgtttgttgcacaatttctgagtctaaggcactcttccagggtttgggactccagtgttgagcaacaccagacaggctgccgtggggcttaccttgtgctcgtgtccttttccacgaggcctcaccatgctgttcctgcctgctggtttctccctgcggggatcccttggctctgtgattgtgacagatacatgcggaatgcactaggcttttgcatggatgttttctttcttttttcctgtatcagctttttcaggttgaattgcatgaatgttttcatcgaaagcccatgatggctgcatgaggtgtaggcgatcatgtgataaaactgaggccaggggagattgacttagtagcctcacttcctataggcagtgaggtcaacatctgttcgacttcggagttgagccaggtcccctgcctgttcttgactgtgccttggctaggtaactgtggctaggtaactgtgcgtgccccttgcactttgctatactcattagttattttgatcttgcattcattattgtttgatatttaatccttcctgtggtatagtggcccctcaaagatgtccacgttgtagtccctgaagcctgttaataagtaaccttccatggcaaaagagactttgcagatgtgattaagttaaggatcttgagataaggagatgatcctggattatgtgggtgggcccgatgtcatcataggcatccttactagagggagggaggagggtgaggtcagagtcagagatggagatgtaacaacggaagcagaggttggagtcaagtggccatgagccaaggaatgcaggcggtctctagaagctggaaaagacaaggaaatggactgttccctagagcctgcagatggaacgcagacctgctgacaccttgatttttgccaagagaaactgattctggacttctgacctccagaactgtaagataataaatttgtgttgttttaagccactcggtttgtggcaatttgttacagcatcggtttgtggcaatttgttacagcatcggtaggaaactaacacccccacatgcattgttatctcagtgagaatggaagcatctggtcagcttggtgtctgcataacaaacacagcagcggctgacatttattacatgcttaggcaggtactgtgcgaagcattttacatcttttttctctccctggcttctcacaatacccccagagggtcctcgtttcttgtgcaagcatggagagtcactcacattgggactcgcatcagatgtgctgtaccaaaaacatatttgatgagctagctaaatgtgggggtggggagaggtaggctttctgagagaagaggccagttggaaactagtggaggttttctcaggtgatcacaggcctgagctagagcgatcaggggcactcgggctagaaaaggcagggattgtgtcagagacattgtgaaggaaacatggtgtagaggacttagctaatgcttgaatgaaggcaggtgaaatcaggagggctgctgaggaatcttactggcacctaaggaggagccgggactcactggggccaaccgaaaatccttctattaaccccactcagaagctttcattggtggtggtggttttgtgtgttcagtaactccgttacatagagaaacatgttaagctgttcaagttactgtattgctgatgggcagtgtcctaaaaggtgtccaaaccaagaaagtgttatttttgttttattttatttttggagacagggtcttgctccgttgcccaggctgtgtagtgcagtggcatgattatagctcactacagcctccagctcctgggctcaagcaatcctgaacgtgttactttagaccagggtttctcaactctggtctaaagtaaccctggcggtggggtaattccttgttgttagggctgtcatatgtagcatatgacgtttagtagcgtccctggtctgttaccactagattgagatattagtagcaaactccccaccctcagatgtctcgaaaatgtctccagacattaccaaatggcccccggggcgggcagtatcccttggctgagaactgtctgagctacctccatccacctggttacaatgcttcatctttagctgctgaatttgtttcaagcctgttgtcagttcctgagatactatgcaacagagacctgatttctgtgtttccatgaacaaatttcaaacatatttatgtgaaaaaccctgaaccagtatatgaaactgggaacatatattactatgagtgtattcttcaattcttagaatactctcaattgataggcatttactgactgtcaagagtatacatatatgcagtgaaacagaagaaaatgcatctgttcacactggtgttctgcagcaacctggagagctggcctggccttttgaatgtgtgtgtgtgtatgtgtgtgcgcgtttgtgtgtggagggagagatcaggctgcctaagatgctccgagccattcagtgccccgagccattcggttctccctttggttcggaggaaggaggggtgagaggagtggagtgcttctgcctttgctcagaaattctacaaatacagagcaaggacatctcgaaaggccgcttatggagctgtgggatctccagcatttttcatctggagggttctcttttcatttctttaaaactgaagggactgagagagagcatggggaggagggagggatgttgatgttgagaatgaacgggggagatggctgcaccaagcctgggatcaccagccccacagtggcagtgggtggatctttgaggcaggcggaggtgccccaagtagctcctctgcccgaggctccgtgctccaggaaagagggcatctaccagcttgggtatggtgtttccaggcggcccggagctcggccaggagaccacatagtcactgcaggagacttgttctttctgccacttagagctctgtcctgtggacgggtgcctgtccccagcatgggggaggccttggagtatggggtcaactagatttaccttaaacattatttccatttttaaaaaattgagatactataaaatttaccttgggcacggtggctcatgcctgtaatcctagcactttgggaggctgaggcgggcggatcacttgaggtcaggagtttgcaaccagcctggccaacgtggtgaaaccctgtccctactaaaaaaacaagaaaaattagctgggcatggtggtgggcacctgtaaccccagctattcggaaggctgaggcaggagaatcacttgaacccgggaggtggaggctgcagtgagctgagatcgcaccactgcactccagcctgggcgacagagtgaaactccatctcaaaaaaatgaaaaataaataaaaataaataaaagtgtacaatttagtgggttttgttatattcactagattgtgcaaccgtcacccctatgtagttctgaatactccataaagaaacgctgtgttcattagcagtcagcccccatacccccagcccctggcaaccgctaatctgcttttcatccctatagatttgcctattcgggacatttcacagggacctccctgtatatttctttgcaacttcctatgaatctgtaattattccaaaataaaaagtgaaaaagagattgagaatgaaggaaccaagcagagatctagttatttataattgaaaaataaatttaaataatctcatttagattttattgtgttttgtctatatagtacttagcatatagtaggccctcaataaatgtttgctgaatgaaattatgcatgtagagacaggttttattgatttataatgatcattctgtattgctgtatttcactgacttttcctcatgtacactattctgatgttctcaagagcagtccctccttgtaagctgtcagagcacccattttattggggtggccacaccttctctcggctctggagttacgaccttgtctgtacttcctggtgatgtcctgattgccctaagccagtgggtctcaactgaggattccctcttccttctccctacacccagagcattcggaaacatttggagagatttttgattgttaacacctgggggtaggttctgctggcatccagtgggtagaggtcaaggatggtgctgaacatcctacaatgcacaggatcgaccccaccacagcaatgaatgatccagcccctaatatcaatagtgcctgagattgctctaagccaatcatacagcatccgggcctgcaattggctgaggcaggagcacatgactcagacctggtcaatgagctgtgaggggaggtatgagacaggcatggttggggagaaggctccttgtccccatagacctacgtggaaggaacttctcctaattgatgctctgtctccatggaaacctggaggtgggcagccacactgatgcccccaaaactaggagggagctggctgagaagctgagggtggtggagtggaaagtctgtctttgatgaggtgggtggatggatgaattaagctttggtagctgtctgccttcagtaccttttcttacgctaaacgtggtaacagcatcatcttatcctttagagccagtcgaattagaatttctgttatttgcagccagctaaggcattctcactcgtgtgttttctgttccttgccgccccatagttttcatgattggcataagatgagaggtttagactgccactgagctgctgtcccctcacttattaaatattcctgtctttttcactctgatatttatgattatataagtactaaaattataatggtccctatgtgcagttattttctctgtagttttgtttttcatgtttgtcttaggagatagttctaggcatggaatgaataaaacccaatttttttgttaatttgtttgttttaatatatttttattttggaatattttagagttacagaaaagttgcaaagattagatggtttccctgttgttaacatctaatatcaccgtagtatattctgtggtgatgtttctttgtcaaacctaagaagccagccttgataacattactattaaccaaactctagacatttgaattttaccattttttccagtaatgttctttttcagttccagtggttttttagaactattaaactcttgatatttgtatggttcaacctaatatttctaagtttgtccttcatctttgtttggtgagtattcttttgtgcagttgacagccttgttagatttgctccaaggcttcatggtagagtgcagggattctaaaggattttggaatcatggaccctgggaaatctgacacaaggtagggattctgcgttcagaaaaaggtaccagcacacagaagcttgcatatgctttcaggaggattagagctctctggaaacccagctgtggttcccagaataatggaggcttggtttgaaatgagcagacacccccagagatgtctgccatgcactcactctgtattgttgaatgaatgcacgctcacatattcaccatcactagcgtaggtgtatcataaaggattaattcaacagtgattcagggagaaccttccgtgctttctccacttcttcccctccctcatatccaacccagctttagactgtggtgtgcagccactggatacacaagtactagataggtttcacatgaaaaggggagctgtggatgaacctcaaaaatgtgacactaagtgaaggaagcagatgtggacacaacataattatatgatttgatttttgcagagtgtccagagaaggcaaatccatggagatcgaaagtggattagtggttgcctggggctgggggtgaagagtgtggtgactgcagttgggcacaagggatgtctttggggtaatggaaacgtactgaaattggtttgtgtgttgcataagtcagtaaatttataaaaaacattgaatcttacatgtaaaatgggagagtttatgatatgcagattatacctcaataaagttgtttacaaacattgttttgtttgtttgcttgtttttagacggagtctcactctgtcacccaggctggagtgcagtggcatggtcttggctcactgcagcttctgccttccgggttcaagcgattcttctgtctcagcctcccgagtagctggaactacaggcgcatgccaccatgcctgactaatttttgtagttttagtagagacggagtttcaccatgttgggcaggctggtctggaactcctgacctcaaatgatctgcctgcctcagcctcccaaagtgctgggattacagacatgagccattgcacctgggcgtttacaaacaatttttaaagcaaatctgtttttaaattcaggtggttaccttgatttggtagttggagaaaccagactatgtagattagacttggcagcctctaaccacgcaaaaagctttttcgggcttctcgaaatgtccatacaatttccagggaaacttgccaagaagccacatgttaacattgcccaggagtcttgccaactgtaaggggaggataccaccatgtaataacccgctaatcattactaaattaaaaatatagtgggtttttcactaaggcaactaactttttcattgaggcatttatctaatagggtgactcattagtaccactatttgttttataaagttgagtgatatctggttacctggcagtatttggagtcaagtgaattttgtgaataaatgaccaattgatacttggcctttaaatattaacattttttctttcacatgtttatttcaatgtttaatattagaagtgtttaggagtctttatttagaagtttggtgatgtttttgtgaccagaaataggctgtaggaatttaactctagttaataccaattagcctgtggtcaaattggtttccttatgtgttgtttcacttaaagttatagtttccatggaactattgaaaacgttagtgaggacttactacttactgtaccactaactgcagggactacctaggtgtgggtagccctgatttcagacatggacagctttgagtctgactcgggactgctatttgctgtgtctcctaaggcaggttatttgggctctctgagcttcagtttcttcttccataaaatgggggcaaagcatttgccctctgggttgttttgaaggctctaagattaggtaaggatcttaggtgagtgtctgctgcagaacaggcactcacatgttctttgtccttgtggtcatattacatactccttcagctttgggatacctcagcatatttagtcttctgcttatcaaaattccctcccttagctgggtgcagtggctcatgcctgtaatcccagcactttgggaggctgaggcgggtggatcacttgagcccaggagtttgagaccagcctgggcaacatggcaaaaccctgtctctacaaaaaatacaaacaatagctgagcatgtccctgaagacccagctacttgggaggctgaggtgagaggattgcttgagtttgggaagtagtggctccagtgagccaagatcgtgccactgcactccagcctgggcaatagagtgacaccctgtctcgaaaaaataaataaatcaataaaataaaaaaaaaatccctctctccatgattccacttctgcttctgagttgcctccttattttccttgtagttgggtagcactggaggctcagcagtgtaaagacaagggctcagagtttatgataactgtttttcctcactaagcaactgttctttgcattctcatgattttgtggctggggaagcgaagttgctggaagtgaaatgttactaaagagagataacagattagaggagagccattgagatttttctgtcaagggccagatagtaaatatctcaggctttgaaagccataggattctctctctttctattattttttttttttttaaacccgtaggacttgtgaatgaaggccatggagattctgttgcaactgcccgaccctgctgctgtagtgcagaagcagccatagacaatacagaaacaaacaggcctggctgtgttccaataaaactttatttacaaagacaggaggcaggctggaattgacccatgtgcagtttaccaccccatgattgatgtcatttgtcattcttttttttttttttttttgagactgagtctcaccctgtcgcccaggctggagtgcagtggtgcgatcttggctcattgcaacctctgcctcccgggttcaagcgattctcctgcctcagcctcccaagtagctgggattacaggcgcacgccaccacgccaggctaattttttgtatctttagtagagacggggtttcaccatgttggccaggctggtctcgaactcctgacctcatgatttgcccacctcggcctcccaaagtgctggaattacaggcgtgagccactgtgcctggccgatgtcattctcgtttactaatacagtcttgcaccgaaatgatggactgcatatacactggtcgtcccttaacattgtgatgccatatttttactgtaccttttttatgtttagctatgtttagacacacaaatactattgtgttactgtattgcctatagtattcagtacagatttgtatcctaggagcactagactctactgcatagcctaggtgtgtagtaggctgtgccagctaggtttgtgtaagcccgctgtgtgatgtttgtacagtgacagcattggctgacaatgcgtttctcagaacatatcctcatcatcaagcagtgcatgactgtacagccaatgcttttgtgtcacacactttcattatcgttgcattagcttggccacaaatctgaaaatactctgagtgtgtatagaattatactgatttctaggtgtgatgtcatagtattctggaacttggaaattgtagcactcagtgatgctagagacttaaaaaaattcacattatatgattagactttgtttcatagctagcagtcacttaatactggacagatgttaagaatagaagttggctgggtgtcgtggctcatgcctgtaatcccagcactttgggaggctgaggcgggaggattgcttgagcccaggaatttgagaccagcctgggctacacagggagaccctatctctacaaaatattaaaaactatctgggcgtggtggcacatgcctgtagtcccagctactcgggaggattgcttgatccaggagtttgaggctgtggtgagctatgatcgccattgtactccagcctgggtgacagagcaataccttgtctcaaaaaaaaaaaaaaaagaattggacaagttgattcaagatcaagatcttcagccacgtctcagcaccctcgtacaaaacctgggaggcagttgtcatatgtgtaccgacagcttttggatgtatatttaaatgtgcgggtgaacttacttttggaacaaaatgaagtttgcccaaatttctgtgctgtttgggtctcggatggaaactctcagagctcagagtcaagggtggcatgggcagcttgtccatgtggatgcctgggaaagtccttgcttttgtggggtcacggaccagtggtgggagatgggaaagtgggtgaagctagttagaaagaggcagcagaagacagtgaacagttcatacagagttggcttcagtgtattgctggcagcatgtgcccaaggctgtaaaagatcttcccatccttaggttcacaaatgccactaaaatagtggtaactctcaggcaggtgtgactgtgccccttgggacatttgcactgtctggagacattttttgctgtccccacttgggggggatggggtgcgtcctgctggcacctagcgggtggagcccaggggtgtcgtccacacctgccgtgcagtgtggcccccccatagagagtgagctgccctgagtcagcagagctggggctctggctcacacctgctccaggcctccagcagcgagctgttctcgttggcccttgcccttgtgggtcttccgctgcagtggtggcaaatagcaatcactgagcgtgtcaccacattacaaggtgcaaactggcagggtgaggttggtgggactgtgtggctgggtgggtgaccgttttgtggagagcggctggagaggccttatttttcaggtgcctgcaggaggggaggagggaacctgaggtgtctagggtcagaggctttcagggagaaggagctacaggtgctaagatgagagcaatgggccaggaggaggatgatggggtcaggcggtggtggcagcacctcatgagccactgcagggactccaggtgtgactcagcaattctgttgggagctattctgttgggagacttaacatttcattgaggtcgctctgactgctgtgggggactaggagggcaggagctgaagcaaggagactggtttaggagatggcagctgcccccagggctgagcagtggtggctcaggccaaggaggaggcagtggggtggcttcctgaggacctggaccctgcgatttggtcctctctctgcttcaccccagctcctgagaccctccctcagaatccttgctggcttgaggagtaaagggttctgccaaagtggatatcaaggctgtcatgggtggatcagcagaggagctggggttttttcccagactgcttctcagttttgctgctggggctataaggaattccgtggaacaggaagtgtgcagggcatgcatgatgtgcctgttattttagcagtggggctgtgtcctaaaagacagcgtctttggccgggcgcggtggctcatgcctgtaatcccagcacttttggaggctgaggcaggcagatcacctgagatcaggagttcgagaccagactggccaacatggtgaaaccccatctctactaacaatacaaaaattagctggatatggtggtgcacacctgtaatcccagctactcgggaggctgaggcaggagaatcgcttgaacccgggaggcagaggttgcagtgagccaagatcatgccactgcactccagcctggatgacagagtgagactccgtctcaaagaatattcatatgtgcttttggaatgcctgtgtaatgctttaatcagtttagaaactgatattttattattatttaaaaaaaagaagtggtgatcgtttgctttctaacggctgggatggtgtggatctaaaatggtagggcttgaagtccacggtggccaactctacagcgcttttaacacttttcccccaggggaacattgtacgttttcttcaggagcactgtgacactgtttggtttgccgtagataatacggattcaaaaggcattccagatacatcattctgtgattgacctggccgggttaacccaagattgtcaccttgttattctcaatagtaaaagccaaggctctgaaaaccaccccactgaacgcatatcataaacctccaaaatgtcaccatggacgtggcatattgacaaaaatgtcaaggattaccaagaatagcttcttgcattcacatgtagttacaggcgaaggacagagtagctcttgcatttaaaatgcgactgcaatggccagaaccaataattcctgtttgaacaactcccggccctcagctttacctcaaggctttagatagacttactttcaatttttgaaaaggaacacatgtccttattatgctttagaattactaatagagataattctctttgttgtgctatttgctactcagctccttttaaaagatagatgacactgaagttttacgtaaacacatgactgataaaatacttgtttttcctgagtcattgtcagtgtctcagctctaaacctagtgccagctcagtaaatatttgatggaatccaaagtctgcattttcttaaggtgggccagtttttctcttgttatataaagtagagaaacataccaccttcttcccatttatttaggagtggttagtagcccttctctcatctgttggggtggtcatcccttttctgcatcagtgaaaataacaccctatcatttcacttcaagcacaaatgctacttttgtctcatttttggagttataaaaccatgtggattaatcccaaccaggtggtggggagccaaagctaagctgtttctttcacctctgacccgcgcgattagtttgtggaagaacgctctccaaacccataggaagttcacagacagcttggattcctcagagggtcttcggtatcgattgtgtagcagaaaaagcaagcatgcctctgggtctttcctctcttctccatagtcttttttatgtctaactggtgttgggttgctttacctctccacccatagttaaagaaagtgagtatcttggcatgttccaaactactgaaataaatgaaaatcaggaaattttccatgaagcaaaccaatgacataatggtacctcaagcacaggagttactggaattggttttgtgaagtggttggccggtaatgtttgcaaagctgggaggtgtaagaagtggttgggttttttttctcaccaaaaagacagccctacattaaagttatagttctcatattaatgaatgggttttaaagaaactgatgttcttcagttctttttttcctcccatgacttgctatgaaagtaaagatgaaacaaaagtatgactgttaggccatgaatctgttactaattaggtcttatgcttactgggatcaaaagatgggatcaaagtaagaactctccagaagcaagaaaaagaaggtgctgggaaaaggcgtcaattgcagcatagtttgtttataaatgagcaaatgaattgtatgtacagcgatccttcatagtaactacctctactccagcggaggtgtttaataaaacaatgtcttaccatctctgaccactgttactcacacctgatttctggaatgcctataagaactctcgacaatgaaaagaatcggaacatgataggcttgaagccacaggcatcatttctattttgaggtcggtcttactccttagatttcccacacgaataaaaaacattggcccatctgcagtcatgtggccgagtccttcctgctgaataacatctctaaccacagatggtagccagctccaggttagattgttctttcttttgttgagctgcccatggctccaactgaagtttacctgcccatctggtcttgttggtactcctaagagcccattcatatttgaccttatttggtgttcttaatgagcacacagtggtctgctgatttgtgaccaccactctgtggtttgtttgaagactatgcggactaaactgtgtccatcattctgggggcatgattatgaatccactcactgttctggttatgttgctcctgagtgcctcatatctgtgatgtagccattaccttcattttctgaatgtcgcacatctacttacattgttttaaaatgcacattttcttttctaggaagagggagcaggcaggaatgttatacactttatccatgatgagtgtagcagcaggtgaaaccctgaggtgttggccacagaagtgcttatatatatatatctcatatatatatgagatatatatatttgagacagagtctggctgtgtcacccaggctggagtgcagtggcacgatcttggctcactgcaacctccgctcccaggtcccagtgattctcatgccccagcctcctgagtacttgggattacaggcatgcgtgaccacgcccagctaattttttgtatttttagtagagatggggtttcgctatgttgcccaggctggtcttgaactcctggcctcaaatgatctgcctacctcagcctcccaaagtgctgggattacaggcatgagccactccacccggcccccacttttatattgaaggttgtgtatacatgtatacagtatcctaacctggtgcttttcaatcctagctgcattttagattaacctgggagctatatatttgtgtttgtgccatcctaggaggttctgatcagcagggcccaggaagccccctgacgtccgtctttcctccattaaaaaaatcaaggtaaaattaacatgacataaaattaaacatggtgaaaccccatctctactaaacacaaaaattagccgggcttggtggcatgtgcctgtagtcccagctactcaggaggctgaggtgggagaatcacttgaacctgggaggcagaggttgtagtgagccacgatctcaccactgcactccagcctgggtgacagagtcagacaccctgtctccaaaaaaaaaaaaaaaaaggaatatgaaattaaacattaaacactaactattttaaagtgtacaattcagtggcatttggtattgtcacagtgttgtgcaaccactacctttatctagttccaagacattttcatcaccccaaaagaagactgtgtacccattaagccgtcgctgcccatttctccttatccccagcctcagctgcccatttctccttatccccagcctcaggcagttactcactattctaccttctgtctttatggatttgcctattcatgcaggaaatctgaggagcgagatcgatctcaagatagaaatgatacctgtggcttcaagcctatgatgttccagttctgtttattgtagagagttctgttcttacaggtatttcagaaatcaggcattaataatagtgatcagaggtggcgagacattgttttattaaacaattcatgttaatagaattatagaatatatgcccttctgtggcttctttcacttagcgcaatgttttcaagattcatccatgttatattgtaacgtgtcaaatatttcattacttttttttttttttcttgagacagagtctcactctgttacccaggctggagtgcagtggtgtaaatcacagctcactgcagccttgacctcccaggctcaagcaatcttctcgcctcagcctcctgagtagctgagactacagttccatgccaccactgttggctaaacttcattccattttatggccaagtaatatttcattgtatggctaggctacgtttacattttgtttatccgttcatcatttggtggacatttaggttgtttccctccttttggctattgttaagtgctactatgaaatacaggtagaagtatttgtgtccctgttttcaggtttttagggtatatacctaggtgttggattgctgggtcatatggtaattctatgtgtaagtttctgaggaactgccaggctgttttctagagtggctgcaccttttcttgtttttgttttttgttttttgttttttttttgagatggagtctcgctctgttgcccaggctggagtgcagtggtgtgatctcggctcactgcaagctctgcctcccgggttcacgccattttcctgcctcagcctctcgagtagctgggactacaggcgcctgccaccacgcccggctaattttttgtatttttagtagagacggggtttcactgtgttagccaggatggtctcgatctcctgacctcgtaatctgcccacctcggcctcccaaagagatgggcttacaggtgtgagccactgcgcccggctgtggctgcactgttttactttcccactggcaaaagtataggagggttccagcttttccatgtccttgccaacactagttattttgcatgttttttttttttttggctttttaaaaaatggctaacctcgtaggtgtgaagtggcatatcactgtggttttttaatgtgcatttcccaatgactgatgaagttgggcatctgttcatgtgctgttggccatttgtatatctttttattttgaaaaatatctattcaagtcccatgcccatttgaaaattagtttatctttttgtttctgagttttaagagttctttatatattcagactagaatatataaatgttataaatgtgacgagaacatgactagatacctatcacataaatgaatttctttctttttttttttttttttttgagacggagtctcactctgtcgcccaggctggagtgcagtggcacgatctgggctcactgcaagctccgcctcccgggttcacgccattctcctgcctcagcctcccgagtagctgggcctacaggtgcccgccaccacgcctggctaattttttgtatttttagtagagacggggtttcaccatgttagccaggatggtctcgatctcctgaccttgtgatccgcccgcctcagcctcccaaagtgctgggattacaggcgtgagccaccgcgcccagcacataaatgaatttcaagtggcatccttttttgaaaagtgctcccagtgggttccattagcaaccaggctcaagaatgggaccagcgattcattccttggggcttcttacaacacacctgggaagctttcttaaacatagcccctgtccctcaagccactcaggtgattctgataatacatccccaccccaaagggagcaaacgtaaaactaatacatggcaaagcagttgttaaggtaaccggtgacctgactgaacaggtgacatcaaaaagagaatcctatgttcaaagggaaattttgaaaaaagaaaaaaaaaagagaatccagtggctctgtagagaatcagctgccatcagcttcctgctccctgttcccggaatgcccttgcagagcatttgtgaaatgtgcagtaggctgccctttgtcctgatggttcatgtgacagggtggcccagcccctcgaggtgccatcaagacttgtcatgttgtcagacctctcaggaggtgacactttgtccacctgaagggcaccctggcattcatgcgtaagcccttgaacggtgcaatgcttagttctgtggggactcgtctggtcgggagagcactctcagtacttgtttgaaatgtccctttaatcatggcaatgtggcatattgaggttttctaccatgaagaacagtatctttagcctgctttgcccccacccaaagtacccttaattccaaaggatggctgagggctgggctcaaaactgagaaagtgggatggttccggggctgttggtggagctttctaatgaaagaagttctccatctgataggaagctgagcatgggggcaggagagagagggtccccagggttttctgccccacaggaatctcttatgaggaaaccccatccatggatctgggatccaccctggtggttcccttgttgcttctgggtccataggggcgggagagcctaccgtattccacgtgagtcgctcttccttcctgtcaccttctgcaccagtccacaacctggaccctctttccccacccttgtctcctgctggtctaaaatgagttacttatgtacaaacgttgggaagaacatagggattactgagaccagatattgatatgtgggaaaagagaagaaaaaatagtgcttcaaagggcttcagttccatataaatgcatgtgttttcttaaattccatgtcagggcaaaagcttttttatttttatttatttatttattttttttttagcaaaacatttttttgctgtgcattttctataggattatcttatgtacatcatattcagtgttacagagaagaaggcaaaggaaaatctgtttcagtctcttcgtcagccatacatgtcacacattagcacatgctctgtataccagttttaaagattgattactatttcaaaaccatcgcctccctccaaaaaaggagaggctgggtctggtgtaattgttgcattttactgtttactccatgcagaagcacatcacggtgaaatgtacttagtttatgtatttggctggcatttttcttttctctcttctctgccagactttatcgtgtcaggggttgccctcagttatcctgtttctcagagcttttcctgcacttggcaaatggcagtgcccagtcttccacagctgggtggatgagtaattatttgatgacagttctgaagacactttcatcattcaaggtggaattcctagtttgaaaaacagatgctggtgaaaattactcatcatgtgccctccatatatggttcctgtttacagtataggaaaaaacaaacaataaaggcttcaccccaagtcaaccagatatgtgggcattttcctcacacaccaagcaattctccagtggataccaactggcatcctctaattcaactcacttctgataccgtctacctagagttagagtcagatcccacaggttaagttccacaagactgccacccacttcaaatgccagtcacaagtagtagactgtcacccctacttctgactgaccagctatgaatcaggatctccacaaccccctccttggttttgattaatttgtgaggactgcttacaaagctcagggagacacgttccccagtttattgcgtgagtaaaaagtatgataaaggatacagacgaacagccagatgaagaaacacacagaggcctggaaggctcctgagcacaggagcttctgtccctatggagttgggatgcacacggatgcgtctgccaacccgggagctctctgaacccggcactttaaagggatttttgtggaggtttcatcacgtaggcatgattgattattaactcagtctccgcctttctccctctctccaagcctccaatcatggcttggtctttctggtgcccagcccccatccaggagcccaccaagaatcacctaattaaaaaagacctcccatcactcaggaaatcccaagggattaggagctctgtgtcaggattccagggtcaaagacgaaatatcagaacaaaagatgtacctagcacccctattgctcaggaaattccaagggttttaggagctgtgtgccaggaccctggagcagaagcaaatatatttcttcatttgccacaatatcacacttctgaccctgctcacctggaatcttccttgtccatttagatgccaggcacgtgggggacagatgaatatttacctgtgagcatcagtcatacaagtggttctaaacctgggcttccagttcgaatgtagcatttcagaaatactgctgcctgtgttccaccacagaccagttaagtccccatcgaaatggcccctggccagggtggagattcactggctatgggactccatcttgctcacaataaccagtgaatgtttgttgatcatttcaaccccttaatgaccttggaaactagaaatggggtttgtaaaggggaaagaggtggaatagctataaatgccacggtattatttttatggaatgggagtgggagtggggcgtgggtagtgaggctggggctaaggtttgatgttctgctgaccataaaataatttgtatttgtgtcgagtagctttctcctctcagctcccatggctgtgtccctgcctttgagtgaatctgttgtgtagtggtaatttgttatgtatttggtcccccggtgagctgaattccttgaggttaactcctggcactgagcatctcaaatagctttcctgcagtgaatatttaaacaaatgaatagcactttgcagttttttcacagtgcttttcctagggtgcggtccccaagccctctcatccttagccaagattacatgcccgaggcttgtgagcatcatttagaccaagcttcatgcatgccttgcctagcaggagctctctgtacataccatctgtttgccaggaagactgcccacctctgtgccttggcatggtcattacagacaaatgcccactggggttgggcctacaaccagatggcaagctgtcagaggggtaacagggagtggtggggactgtggtgaactagcgagcagccccttctaaagggatggctctagtcagctttagccagttaccgtctttgggcactgtaatccctatgtgccaacccttctgattttctttttttaatttaaaacaatttaaggaagatggggtctccctatgttgcccagactggtctcgaactcctgggctcaagtgatcctcctgccttggcgtcccacagtgctggagggagccactgtacctgtccgcttctgattttcaagggagttagacattctgggttttgaaatgaaatctgagttttaatgttggcagcccgttgaggttttggtagagcaccctagggccaacacagcaaaccaggcagaacacttctgcagtgcaggtggccctgggcagccttggagtcatgtggttccagctctcgccacctggcttgcccctctctaaggcagagaggagcagaactcaaaaaaattcagtgatggctgcacttgtccttagggatcatgggaagaggaggctatgttagattctgggtaaaagcttccttttaaaaaatggcttttagttttgtacacacaccacaattccacccacttccctactgacaattacagctgtattggggtgtcttctctagtcttttttctttttgtaaagaaagaaaccaaaatgtgattatatatcaagtaatttttttttttttttttttgagaccgagtcttactctgtcacccagtctggagtacagtagcgcaatttcagctcactgcaaccttcgcctcccaggctgaaagtgatcctcccatcttagcctcctgagtagctgggatcacagatgtacgccaccatgcctggctaatttttgtagagatgaagtttcgccatgtcgcccaggctggtcttgaatgcctgagctcaagcaatctgcctgcctcgacctcccaaagtgttgggattacaggcatgagccaccgtgcccggacttcaaataattttatagccaccctttctcctaacgatttagccaaagtactcccaggttattacagtgtcttatttagcatattttgaaaattatcccaggtagacctcaccaacacaggagttctggttttgtgttttttttttctccatccacagcacctaacgagagcctcacatgtagccaggtattcaaggactaactctcgatgattgttgctatgcagtagtttgttggatcacatcctgagcattggacattggcttgtctccttttttttctgctattataagtagcactgtgatgtacctgtttatatgtgaagctcctcacgtattttagagaatgatcaaaggtgatactattagcacttggggctgggtaattgtttttgtaggggccgccctgagcattggaggatattgagcagcatccctggccaccacccacccgatgccaggaactcttctcttctgtagttagttataacaaacaaaagtatctccagacattgtcaagtatcccccggaggcaaaatggtagttgagaatccctgcgctagtgtaattagtggactgtgaagggtgccaaagtcttaaaagattttagaccttaaagtatgtgctgcttggggaaaatactctagtgaacggttgtccactgcctctgcctgctcctttgtttccgccacactccttcccctgagggcaccgggttctcccactgttcttgacactggagccgggctgtctgtctgtgtgtggttgggctgccgtaagagtaccacaggctgggggcttcagcgacatgcatttgttttcttgtggttctggaggctggaagtcccagatccagttccatcttggttggttggtttctggtgtggactctttctggcttgcagatggccacctgctcactgtgttctctcaaaagtggatgggggccggggaggggggcggcgccgagagagagagagagggggaagagagagagagagcgagcgagtgcacttgggtgtctccgctttctataagtgcaccagccctatgggattagggccctccactcatatgacctcatttaacctttatcatcccttaacaggccttatctacaaatgctttggggttcaggtttcaacatgaattttgagggtacccagttcagtccatagcattccacccctggccccgcaaaactcacatccttctcacatacaaaatatattcattccatcccaacagccccaaaagtcttaactcattccagcgtcaactctaaagtccaaagcctcatccagatctcgtctaaatcaggtatgggtgagacttgaggtatgattcatcctggggcaaaatttctttccagccatgaacctgtaaaaccagacgtgtgcttccaaaatacaatggtggggcagctataggacagacattcctgttccaaaggggagaagtaggaaagaaagcaggtcccaagccagtacaaaacctagcaagacaaattccatgagatcttaaggctccagaataatcccctggctagatgccccgctttccaggcccactggggtggcagcatcaccctcacagctctgttaggtgcccttctttgactgtgtgaggcccccaccctctgaaactgaggacgaaacggccttgtcccctagccctgtgtgggagtggcagcccggatggtctttgaattgccttcagggtgattctttgattttcttgaagaatagtctgtgttctcatctgaatatatctatggtcgcatcctatagaatccaagaaatccaacagccttgtttcattcacttccagtttctctgtccttgtagttcaaactggcagtgtctctgctggtgtaagcccatctttcttcctggcttctgctaagatggctgattaacatcacgggtaacctctctatggagtgactgtccagccacacccttggcgttttctccagaacaagctccctcatttttgcatccatctgcccatccctccctccctccgtccccccatccctttgtccagtcagccatccctgcctccattcatccctgcttccattcatcctttagtccatccttccatccctccctccatcctttctctctctatccccccactcatctattcatctgagcatagcgcgctccaggatcccagctaggtcctgggagacaggacctctatgatccttgactttgtggtgtgcagagtctggtgggggcgtctggagacacttgcccttcagtgaaaattcagagctaagcagcatcttgggatcagggttgcctgggcttgtggtgaggctgcctctccagggaaaggggactgtggatgcctggagtgagaagactgagttaaggtcatttctgagtgtagagcactggactagtttttgcaagatgcaaaaacaaagggcctttgcccttgcagccttgttctctgagattgggtttctagaccatcatgtgtgaaagccaggtgagcatggccctttggcctcccttggtttctggacttggcagtcaccccttccttctgacatgccccctctgccatcacaaagccgacctcgggcacgcgaagtttgcgtcagcaaaaggaactcactgtggagtcctgataagcaatgttccagcgatatgggtggccaggcagttctgaacataattaagcaggcctgatttacctgacagttctcttggatgacagtgctgaaccctcagctgctggctcagttttggggatgtgcatggacaagtttgagagagcaaatgtagttcagaaaaatggcaacttacttgttctcagtgttgctttcagtcttggagacatctgggtgttgtgcttttgttttgactggccagctgtcctgcccagccgaagctcagctctgcctagccagggctcgaggtggggcttctattcctgcctcatggtcacgtgcatcggctaagagaaggagctcagggcacagccacaggcctccgagtttgtgtggctgaaggttggttctgcaggcttcctagtggtggtgtaaagattggaggaacctttgcagacggcccagtgtgtgtcctccgaggggctcactcttgcccagcacacacagtcagcctcaggtggacttggcccagcgtgtgtgagccaggccgagaatgcaccgcttccctgaggccgcaggcacatttcagtggtggtactggagaggctcagtgtggatggtaatagcctttcggatgctcaaggatccagaaatttctgccacagtggcaggggcatatggtgacatacactggcttggttccatgtagtatagagtttggaataattgtttttatgtggagtatttcctgtgctcctgcaggtgaagaactttacttcttttctcttctaaaggagaatttggggctccctactaagctgcctcaggtggttgctgataggtctggcctctgcgtgttttggatcaagtgttgttgcccacagtcctgctctgaggattctgttgttgttgttgttaatgattcttgtgagccaatattgagcaaaatgacagagtcctccatcagtgcctgttcttttattttatatttatatatttatttgtttttttgagacggagttttgctcttgtcacccaggctgcagtgcaatggtgcgatctcggctcactgcaacctctgcctcgcaagttcaagtgatcctcctgcgtcagcctcctgagtagctgggattacagacactcgacaccacacccagttaatttttatatttttagtagagacagggtttcaccatgttggccaggctggtctcgaactcgtgacctcaggtgatccacctgcctcagcctcccaaagtgctgggattacaggcgtgagccactgtgcctggccagtgcctgttattttagagggggcttcctatatcctcaggacgtctcgagtccagctcaggaacacctggacttccctacctgttcatttgacatacctgtgtgtcaggcccctgctaggagtctgtgataaaggcgacagggaccccagtcctgccttcttgaaggggagcctagcatggtagaaatcttcacactcatcataagttaccactttaatgggcatgcgttaatgcagagacactgcagaagacgtcacactccatgttttcctgatgccgcttaacagggaaaccatcaaggtcacggaaacgggcagaaatggttacaaagtgagctctggcattgccgtccctcttgcgatggtatggagcggagatgatggccaagctcccagtcagtggcctccttgtggagtcaagaaggactgtcctggcccagtgcttgctcaggcccccttgttcctgccttgctcagacagcgggctcccttctgcccacacctcagcctccctccccgctgttccctgcagcctctttcgacaaagcagatctgctgatgacaggccctgcttcacttcccagtggcgtcctgccatctgcagaacccatctccttatcagggtggcccaggctttcttcaggaggcttcctttcaccacacccaccctcacccaacctagggcaggtcccagtccatctgggacttgcccatcatggctccagcgtcccccattcctcccctccccaggcaggttagaagcggccttgctgctcctgttgggccttgaacccagtgcttctaaaacccacccatccccacgagctgcgcttgtttgcctgggtggctcttcccctgtgcctggagctttgggaacagggttcctgaaactggagttcccagactggtagcattttgtgtatctttgaggcagcatcttgggtgtacatgtagacacatctttccaggcaggacatcgatggcttgtctcagattcccaaagagatccaagacttaaaaagaaccactgcctggggcggctgctctcctctgcatcctttcctggcacacaattaatatgcgcaggctggatgactggaggtcacagatgcttggcatttccccccgtgcttttgttcatggattcagttggtgatatatgcagcgatgcatctataaatagtggaattctcatgccccaaagaaaacgagttaagtgactgctgaaagttgttgttgttgttgttgtttttttccttcggggtgtggggtgttaattaatgccaaaaaaggcaggtgataaaatccttttgttcttactcttagaatcctggtgcaggactttctgcagctgggctccaatacaaaccagagtggggaggggacttgatcttggcagtattggaaaagctttaattgatactatagagcccgaaggactgacatctttacccctgtgtgccgcttgtcgtctgaacggatggccgagacgcatcctgggtcgccttccctgtgatgccatttctaaagaatgttattgttcagccccttcgctctccttggccagtgtagttttccttgcccaattcggttgaatttacttcttccgtccattgttactatttgtttctttatttcccaaatccttccttaaaacttctcctttttaattttaaaatatctcttcctgttgtattcagtagtaaattaaggaccaaaatattataatactgtattttattttgaaaggactgtgttaagactcccatctaaaattttggcaatattaaaagtaaaaggctgatcgtttgcttctctaactatactctcaccagagtaatcatcgttagaaatttgtcaagagggtaaaggagataagaaagtatttaaaagtggaatacggttcacattacacttattcctataaagagctcttggaacccttgaagtttgcttggaatcggttctctgagttccgtgtggaagtgcagggagctggctgcctctggcgtggcttccaagtccttgactgcccttgcccacatcctggtctcaccacttctcaggtgtgtgtccctgagctcagcttcctcctaggtaacatgggatggtgatagtgggcccacctcctcacgctatcgtgatgattaagtgtttggttgagcacagtgctgggctttgctgtgtggctgcagtgttagtttgcacacctggcaccgtcccgtgcagtggccctgcacattcagtgctccagtatttacatgatgtatctatgtatacatatgtcctgcagctttgcctgtccaagtactgtggacggttaccaaaaataaggagcctattttaattacatacacaaccagaagaaaaattaatgacatgtacatactgtactgcccctaggaagtatgatgtgctttaatattttctttttaaaataaaatactgccagggacctactcactcaatttcactgctcactgataggttgtgactatagtgtgagagccctgatatagagagtaatgggatgaatgaacacaaaggattggaagtaattagtttcgggaatgtttcaacatgtgtccagatggaagatattctggaacatccaccagccatgacttggaatttacacataaaaatctccagatgcatctaacagcttcaagtgagtgagatgacagcgaagctagtgatagcatccaagtcttgtgtttttttcttctcccaagtatttcatgtgacttggaatccttaaattcttttttccccactgtaaatgaagtattcaataagaacgtcagtgtgtgtgtgtgtattttaaaaacagctttagtgaggtgtaatttccatatcataaaatgcacccattttagtacagtcctatgaattttagtcaattatacagctgtgtgactgtcatcacaattaggttgtagaacacgcccattgtcccctgctgtccccagtcccacttgcctgactaccactgcctggtttctcttagggaaaggcatgtttcagaagtcagactcctggatggtatcatttctctgccctccttgacgagggaactgcagtggcctggggttcttcctggtttctgggccatcatgcctgaaagcctggtctggagccagtgaggaggacccatttgggtccatgggagggggctgggtactgagggctggtctgtgcgtgcgtggggtgggtctagggatttgtaagcagctgtagaatgaaggctcagagctgacttgggagtcccctaatgaggtcctctagcctgcattggctccccctgttagtgctttgcagccatgatgccattcttaatgcgacaagcccgagtttccgatcactctggtaaacagctcccgagcacctgttctgcccagtccctgaagaggaagccatgcatctgtcacactgcagcccattctccctctgatccagtctctccagcttccaatctgcacacctactcatgagcatttcctgtccagaccagtaccatctacaatcagctctagagctgccacagacaacctgttttgggtggcagactccattcagcattgatcaagtaattccgactcatcctgtatatgcagtggagcacctcctgggcaagtcctggagccctgtgggggtcaggtcagcattggaggggatgccagccttgccctgaaggaactagtactcggggagatgcaatgtttattaatgaccgcattctacttagagttttaagaactgccacagaagagatcaagtgctgaggctggccaaagaaaggccagcttgcttctggctgggctgggctgggctgggtctggacctgaggaatctgggccacatcttagaagaagcattagcatttgaacaggaaaggggcggggtgaggggaaacttggcaaagggaaagaacaatccaggtttggggatagcagttcccatgggttactgggaatgcggatggatatgagggggttggagggaagccaggagttccctgtatgcggttttgtggtcttagaagtgtggttccttcaaaatccccactagtggcttgtggaggatggcaactcaggccaggtctttcttaagtgatgcacctgtgcacctgtgatcatttgcagactcaaattactgtagaatttagatgagagtgtgacgttgtgatatccagtgcagtagccacagccacacgcaaatgagcacttgaatcgggtcagtcctaaaatgaaatgggcttaacctgtaaaacacaccgggtttcaaagactccattgaaataaagaatgaaaagcattccatttgtaatttttgtagtcattacgtgtaaaaatgatagtatttgcagtatagtgggttaaataaaacatgttttaaaattcatttcgcctgtttctttttactcgtttaagaagttttgcattaatatgtgggctctcattctgattccattggacagtgctgccccagagaattctttgtaccagctgggctaaagtctgtctctattttatttactgtaaattgtatccctagaacttatatatggaggtgaacaaagtgttttcacatcagctcaggagtgtgctcttgataggcttgttgagaaattccttttctctgttattctgtctcagagggacccttgctggggggcactcagatgatggctgcggttgggcgcccctctgggtttggtttcctttgggtggtagactcgaattttggcctcaggtcagcttgcttttagattatgttcctttcatacagtattatgctgctaaatcaaaataatagcgacattcttccagtctttagaggaaaaaaataaaatggaaggaaaacaggcattactggagaatgtaatacattccagaaaccttgataatagtctcaggccttctgcctcatcaccttatagtaaaacggagaaaatggaggcacagtgagactgagtcatttgcctatgctcaacctctaggaagtacttaaagtatagtttcctcagtttgaagtttttctcccttaaagttttaaataattgttcccatctatgtctgtgattcaataaaatatgtaccgagggaccttagatgtattcagtcattactgggtggcatttttcaggtgtttggacttccattgcaccaatgcctgaacatgcctgagaaccggtaggatcactggggctgcagagccccaggggtttgctggttttcttgaatacctcctggactgattttcctagaacagtttattctttgctggaggatagaacatcttgctaagatcttgtctctttatcttctctggacactccctttctggtgggcagacccacattcaggaaaccagattgtagatcagaaggtggcatggtcagtgcaaactcagaacaaaagacctaggggaggtactcagggatgttgcatcaagctctggtagctgatgaaagtcaccttccttccaaggatagatctgtctaaaaaaagagctgtccgagtgaggaatgaccctgtagtgctctggcctcccgagtcctgcatttcttataatctaggccttgtgatctcagtcaagttaaaatgcccttctgtccccttccagttctttcttaagtgttaattggctccaaactggtttttctatggtatcagttcctgaaattggccggattaatttatcatgcactttaatgaaggactcttgtgtttgagggctctggcttagaaaggtgaatcctttcttccaaggaactcacagactgttaggggaggtagcctgtcaaatgatgactatgctataaagcaagaagcactgtccgtaatggaaatgtgggcagtggtctttcttacccctgccccgcaggactccatagtggggaagtacaaaccagttctctccaaaacatgtctatacttggataacttttttgtgaatcactaaagatgctcatgtcatcaaatgagatgaaatattcagacttttcacaaattctgattatttccttcctttgtccagatctccaagtgggttagccagctaactatactaacagctccaaagtcttattgcttagcagaatagaagtttctcactcatgtaagtttagtattggttggggcgtggagggtggacccaggctgcttctgtggtgtggcttgcccattttttgaggctttgctgtcctccagtgggttctttgctttgggcccacaggcaagggaagagagaaggcatggggaatcctgccagaagcttctgggacaagccttggaaggggtgtacattgcttctgcccacattccattgtctagagcccagtcacatggtgccacccagctgcaagggagagagactgtgaagtgtgatctctctgtgggcccaagaggaagaggaagcaggggtttggtggatatgtagcactgttgctgctccattgctttgggtaacaaataccgactcataggaggcagcctttaagtattggcttcactgatggggtagtaccgtttcattgtgacaattaaaagatgcatctggcatatttctcactggggttttatgacctgagtgatatccctgctgggatatcagtaacactgaccttcaaactcaggcgagttggctgtgaacaggctcccccagctctctcaggctggctggcccattgcttcactgtgaaaagctatgccctggagaacatgctggaacctggcttttcaggtggacgttcaggaaggtgtaggtgccaatgaggggaattgtgtcctgggaggctcatggcaaggtagaaaagtctcagtgagatggacatggttgagggctagaggacagtgctacaccttgtcaccactgaagcagtgagacagatcttggtggtgtgctcttcgtgtttcagattgaagactctgaggctggcggtcttctgtcaatgcagctttgcactcctcaggcacaggggtttacctgcatctgattctctgtggtcattccccacctcccccgcaaaaaaacacctacaggcatccatggtcaagtgtcttacggatttactgccattcataaagcctctaaacatcccttttttccttgaaatacatttgaggagctgtttgctttttatattagtctgggaatttgtccattaattatgatagttttgtgttagagacaataaaaagactgacaatgtataatttttttttttttgattcttaagaggacttcacatttccacaaggaaattacaaatgttatttaagaatgattagttccgaggctctatcactaacagtcgggacactcacactatattaatacatggttgcaacgtttagattgagttctaggtgtaattactcattgccctacattctagacttatagaattggacttgaagacaagagccagttcaattcctatgcatattctaaataaataccttgggcaaaaacacagattttaaatgattattccaaatggcttttcaggattagtgtgacaggtttgtggcacattcactactattttaaactttgacagaggaacgaggagtctctctaaaagaacttctgagcttcgtttttttggggtgatcaacatccctgggaatctgatgaatgccatgtactgtgcttatcaatttttctttctaatttcagggagctcagggacccgttctctgctacgggagagccgtggctctgagtgtaaatgcttgccaccaaaagcttggagaagcaactagcacagcaaacagggtcaaattcaccacctaagtaaccacaagcgggctggtgtccaagttccggcgggctttgaaactcactgtgagccaggtagcttagaaaaggtggaggaagtcattaggatttcctgaggattgggttggaactgaagccgagattaatagtgtcctctctgaagagcattttaacaaacgtgaattggaaatataaagatcttcttgttccctgagactggaaggtgtagcacaagtgccagagcattgccctggcctccttttgatggagagaatgtgtgagggatcagcagcgctcatcccttctcactgttccaccttctgctacccacctgtagtttcctacagtttggtccagggaaggtgtgggcttcggggcatgggtctgccaccgactgccttgctcgctctctctggccctgcagtctccccagctgctgtcttgtggtcagcagaacaatggcttccaagatgtgcatgtcgctaagccctggaacctgtgaatatgttgacatgcgtggcaaaagggactttgtagctgtgatgactttaaggatcctgcccagggaagatggtcccggatgatctgggcaggcccagtgtcatcacaagggtccttatgagtggaagaaggagacagaatagagagaaccagaaagatggcatcctgagaaagactcatctggccatgctgcctttgagaatggaggaaggaaggggctactagccaaggactacaggaggcctgtaggaggtggaaagggtacaggaacagattctccccagaacctccagaaggaatgcaggcccctggacccattttagacttctaatgttgagaactgtaagggaatccatttgtgttgtttaaagctacatggcccaggtgccatctctcaagggacccagcaggatacagtaggcgaaaagggaacaaaagctgggccgtgccttctttcttctctcccctctctggccctggaatgaccagcagtgtgtattcgtgtgctctgctgaaccaagaaatgtggtttgtgaagggcacgatctgcatctggcagctctctgggtggtggctgagggcagagaaagtgagtgactctggggttgatgctgttgcgggggtgggatgaagagacagtggcagctggcccaggaagtcccccaccttccaaaagcgctgtcaaacctccgctgtctccctaccagcttgttccctgaaggtcagcccgcttaggccatgtggattcatctggagcctggggctgaatgcattaaacttatccccagaaggtggtgaaaaagaccacttctttctttgcaggtgagcatgtgaggcgatgggagagcgctttggcaacatctctcaaatatttactgtcagctcctctctcttacttacagtaaagagcagaaagctgggacgtacctaagtggatgacccagggtgcctggtaaataagtgacgccgacagagctaaaagacgtgaggcaatacccaactgaaatgcaataagtttatgacattatatctagtatgatatgagctatggaaaaaatgtaggacaaagaagagagaaaaagaagctaaaatgtgaatccaaggcttctggatcttgagtggttatattccatgtagacattatgatctgaatttttgcatcaaatttaagatataggggtaaaacttcatatcctttgaccttgaaatttaattctgagaattttttcaaagaataattataagtacggcttatgagctttatagacacagatattccttctatcattaatataaaattgagatatatttcacatgtgccataatagtcaccatttcaaagtgtacagcagtggtttttagtatattcccaaggttgtacagccatcaccctatctaattccagaacattttcttcccactaaaaggaaaccctgtgctcgttaacagtcactcccattccctctttcccccagcccctggtcaccactgatccactttctgtctctctgggtttgcctattctggatatttcctttagatggaacctcacaatgtgtggcctctgtgtccggcctctttcacccagcacattgacttcagggttcatctgtgttgtagcatgtatcaatacagttgacccttaaacaacatgggtttgaactgcatgggtccacttattctcctgcctctgtcacccccgaatcggcaagaccaaccattccacgtccatgccggcctactcagtatgaagactaagatgaagacctttatgatgatctacttccacttaatgaatagtaaatatattttctcttccttgtgattttcttaataaattttctttatcttattttattgtaagaatatggtgtataatgtcaaaatatgtgttaatcaactgtttatgtaatcagtaagatttctggtcagtagtaggctgttagtaattaagtttttggagagtgaaaagttatacatggattttgaaagttcgtgggggtcagtgccccaacaattgcgtctattcctgcattcctttttatgtctgaatactattccatcgtatggctagaccatgttttatttatccattcagcagttgatggctgttagctgtttccaccttttggctattatgaatagtgctgctatgaacattcatgtgcaagtttttgtgtgaacgtatgttttcatttatcttgtgtatatacttagaagtagaattgccgcatcatatggttataactctatgtttaagtgtttgggaaattgctgaactatttcccaagcatgagtggctctcatgcatatttatattagtgaaaatttggaaataatgtagatgtcaatagtaggagagtgcttaggtaaattccattaatccctttagtgaaggatttgtacaaatgcaagttatttattcagcaggaattattgaacaccagcttcatgccctgtcttggaccaaatcaaaggtgattgagatggggtaattgttctcaaggagcttgagctattcagctattccatgtgatgtttacaaataatttatgacaagggggacagaattcttacgctataggggtaggctagctcaagtaagttttggagagcctcaaggtacgaattaagtaaacatgttacaaagttaagtggaaaaggtaggatagataattgcacatactgtgtgatcatgagtacgtcagaaaataccagataaaaacaactcatcaaaaaaaggtggagaaaaacatactaatataggaatagtggttgcctttgtgtggtggtgtcaatggacatttctctcccatttaagtgtctcctaaattttttgtgatggaaacaaaaattcccccagtctgtctgtggagactgggaaggattgggtgggggagaatctagcatcaagtttttggggagatgagaactccagaacctgagatggcatccctgtgggtgaagacagaacctcagaggaaatactagtgtgtgcgcgctgctatcctgcaccccatcttcctctctttctcagccacctctctccttttgatatcccctgcccatctgtggccctacttggacaccagtaataccccactgggtagttaataaggacgctttttacgattctcagaaaaaaaaattggtctttaaagttattaaaaggcttagtgatgtttttaagaagacacaattgaattgctaatctatttgctcaaattctattatctaatattatttccatgtattaaaaaggattctaaggtcagaaatgagaagctgccctagccagctgatctactggccctgactatttcagaatactctactttgggactgctgtcaatgttgggaaccccatcacagttgaaactgactagaactggggatgggggagtaccatactcagagaaacagggatcttagaacaaagtgctttttctttttagctctacctttattttcaattgtcttctcagcattttaactagtaaaatcaaatatgatgaaaatcagttggggcgtggtggctcatgcctgtaatcccagcagtttgggaggtcaaggtgggaggatcacttgagcccaggagtgtgagactagcctgagcagcatagtgagactctgtctctaccaaaaaaaaaaaaaaaaaaaaaaaaaaaaaaaaaaaaaaaagaaagaaaaatagctgggtgtggtggcacttgcttgtggtcccagctactcaggaggctgaggtgggaggatcacttgagcctgggaggttgaggctgcagtgatctgtgattgtgccactgcactccagcctgggcgacagagtgagaccctgtctctggggaaaacaaaatgacatttacaaaaatagaaaatattccccctggtgacactttaaccacaagattagaagccctacatctttggtaggtgtgaaaatagcttggagaattaaaattaggcataaataaattcctgatgtctttgagagtttaagtcattggatgatgctgtaatagaggagaatctgggagatgttgaggcgtcaggttctttttcatttgaagctaaatggcctcagttgggtggtttgagctctcctgttttgtttgtagatttcctgtctccttccacttggtaatagaccactgatttctctatgctcctccttgtgatagtgtgccgctttccacttttaatttttctcttctgttttattgtgaggggagtaaactgcggtattgccattcccctgctttcgcatacatgtgaatgagcatgggaaagctgaaagactttagtgcatttggggaaggggatagcccagggctcctttcctgaagaaccgaaaatatttgaacatctccaattctgctttatattttacacatagtccttgacatatttctgactctttttcgcctgcattaaatttctttttggattcaacttagtcctgtggctaagggtttagcctttccacatacccagcaatttctactttcctcttaactgtatacagttcatacagcgcctatgccagcactagcattttcattttttctatccttttattttgatgaaatagtacaaacaaaatgcattaaaccagatgtaagcctggctgctttgaggcccacaaagctggttcctccgtctctggcccaccttggctctaccgtgagataattctgtgtctctatcaatgactgtaaaccgtgcaataaaatgtaaaaattgcccatgtgatgtggacagacgtgaagatgctctgcgaactgaactttttcccatgcgaaggtctggattctggattccttgggaaatactgagaagtgtgaatctggcattgagggtcagtttaagggtgtgttggaaattgcaggtacggatatgtggagtcaccatggccttggcttctgagagaggacatgaaggactctcttaggagtaaagccgatgtgctttaggatcattctcagcttcaaaagcttcttttccctccaagatccctgctggagtgtggttgagtgaggagactaaacagctaaccttcatttatgtggaggatgtgtacaaatgtcagaaacatgacgagcggtgttttgtgtccagtgactgagaatggatgtggctcccaggcagtggagaccgtgggtgtttggcggtgatgatttgtatagggtcaagctggcctttgcagggctgatgggattggggtacgagaggggaagaggaagcctctccacaggtccaggaaagaccgagaacagattgcttagactggaatgagtgtgatgttttggaaggcgggtaaacaaactcatttgcctggacaagagattgtgtgtgtgttggggagggggtggggggtgcagaggggcggtggtagggagttgaagcagaaagagccagaagctttgtatgggcttggcttggggaggacttttcacaccagcccaggaggtttgctctggcaaactcagtgctgtgaatttcttctttttttctttttttgaggatggagtcttgctctgtcacccaggctggagtgcagtggcacaacctctcctcactgcaacctttgcctcccgggttcaagcgattcttatgtctcagcctctcgagtagctgggactgcaggtgcacgccaccacacccagctaatttttgtatttttagtagagactgggttttgccatgttggccaggctggtcttcaactcctgacctcaggtgatctgcccgccttggcctcccgaagtgctgggtttacaggtgtgagccaccacgcccagctcaatgctgtgcatttctgcatggagagccactgtgcttggggaagactctttggacatcagtgtctccacccaagtgggaggatgatcattggcaggatgagggatcatgggattgtccaggatgaagccgaccacctggctgagggtgctgattgtccccagatgaggctgagatcgctcctgggtggcctcggcctcatcctgacatgcaggaaccatgctttttagccagcaagagccagaaaacactccttgctgaaaagttaccaccaaaaaacgccagttttccacacctccagatacttcccctctgacgatgaaagaggagccaagatttattcgtctctcctttggctgatctaagtgcagtggtgtttacaactaattgatcacaaccaattacagatttctttgtttcttctcctctcccactgcttcacttgaccagccttttttaaaaaagatgtgatcaaatagattctggaactgaataactcctctgaagtgatttatttatgactgaagtaatgttactcaccaataactttcttgggagaaaagcatcatttgatattggtaaagtttagagtattcatgatagataggatatgctatacaagagaaaactatgaaatccctggcccataaatattttggaatgataattaggaaaatacatctagacattctcaatgctgttattgaaaatcgtgccagaatttggctctgcagtgctataaggatgggtttctcaactatatttgtttactttgtctatttttggaaataggatcttgtcttgtcacctaggctagagtgcaagtggtgcagtcatggctcgctgcagcctcgaacttctgggctcaagcaatcctcccacctcagcctcccgagtatctgggactaaggcatgggcctagctaatttttttttatttttggtagagatggagtctcactgtgttactcaggctggtcttgaactcctgggctcaagcagtcctcccaccttggcctcccaagtgctgggattacaggtgtgagccactgcacctggccagtatttgttgattaaatgagatcgtgtatgtaaatgtgcttagaatgtacctgtgcatgggcatttttctctagaggcttatttgtgaatatcattacgttagactagcagcaatttgctcagaactcagtttgtgttaaagtaggattttcttttttgctgtggttgggtcccattcaggatgcaaatcatgcacaacagtctgctgttacctgcttgactgggaccctcgatacggcattacgttcctgactggtaaaggcattgtgctgcagacatcagttccaggatgggacaaactacatacagtaggctcatcttgtgatgtgattttttgagtgagtcgtgtttgggaggatatatatggcatatttcaccttctgtatatttctgtttttatattgtttctaacttcttaaaaccatgtgtttagaatgaagattaaaactagtgttgttctgatggtgtttatcaatttctgaatgcccctggggagagacagccttgttgtcaaaccagtttggggaaattacgtgttcaaaattcatactggtctcatggggcttggctgtggttgtgtcactttctcaggtctagggacagaagaagtgggaggattgacttagtgaaatgtaggtgatcggattcccatgcatagcagtcagtgtgcatttatagagacagcccaagagatagctgcccagactcagacaattataggtgtgtctcgttttatatgacagctgcagtcctaacactgtcttgtcaatcaatgtgatcatgggggatcggggaggggggaggtctacttttaaaaatccatctgaaaattctttactttatctctcttgtcaagcccaaatttcctcaatcagattttcttcagggagagatgcctgtagacaaagtgcttttattgtttttctccagaaaaataaaaaaggactctgaaatttctgattcctactgtataagaaatacaggaagcatttagtaggggggagggcgtgggtatcattgtattgttaccttgcttggctctttgcatttggccaatggttgatgtttattaaactcatgaccagtggtagatgaaaatattgcaaatgcattttatatagatttaagccaatgttcatgtgtaatgtatggaaactgaaagttgtgaggggaacatttctcagggaatgagaacagagcataggtgctctctgatttttctggaagagctacattccattgtcgtcacctcattaaacatactgcttggaagaagatgcttgctttacctgttttgttagtaaccgaatatctctttttgctcacatttaaagttgcactttgagatagtaatgcttctgattgcaagtgtactaatgcagttatttaggcaaagctggtgaattaattttccaaccaaatatttggagcaaaagcagtcaattagataagataaagcaaacttatacaaaactgacctgactttcaaatttgttttcataattttattttgcaggataacaaagccattgacctttgccgattgtgttggggacgaacttcctttaggatgggaaaccgtatatgataaacaaattggagtttattacatggaccacataaatagtaagtagtgtgcaaaatctgtggcattatatcaaagatgccaaaaactttttgtagagtttaacaatcgttaccttccaatgcagcattaaattgggttttataaatgtaatgcgaagtttccattagctcagttcttcacaaagtgaagcagttctgtagctgtaccttgcttgtgtcttgctagggactgcatataatatgtttaatggagggttttaataactattacaaggaataaatttcccaggcagtctggaaatagagatacctctcataatgaaaaaattatttgttgcagagtggaactgacaagttattggaataagtgcccaagtgattatgttcacttcatttcgtcttatacatttaactttagctttcatacaccaaaccttttcggggggtgtgtgtgtgtgtgtgtgtgtgtgtgtgtaatggtatagagaccatagcaaaaacaatgggtctttgaccatgccagcctcctttgtagaactgtctagagcagtgcttctcatcctgggtgattttatccctcagggacacttggcattgtctggaagcattttcagtggctgtgcctgggagaggtgctgctggcattcagtgggtgtagaccagggatgctgcttaacaccctacaatgcacaggacagccccccctcaccagataatgaggcgatcccaaatgtcaatggtgccaggatataggaaccctgttctagatctgttctttgccccttaatcttggctgtctcttcgtcagctttcttcgatggggtcccagctgggaatccatttttcactctctctcattttcattctggcttccctcagtggctctgtcattgtcatttcactaccaggatatgaagcatggcttccccttggcttactttctgtcctttggttggtgaagtgcggggcggctgcagggtctgaaggtgcatggtgccccccacctgagtgattttgaggcacttttctagtccagtgccatgactcctcatgtccccactgtgcagtcaactcagattggtgtcttcagggctgattcctacattgtcagttgctggcacccaagatctgagtcccccatctcagatctcggggcagtggggtttttggtgcctggcactcgtccttgggcacgattgcagctcttatccagagattgagcagtggtgattggagacaggggatacctaccgttatggccctgctgccctcccaggcaggtccgggtggcaggaggacttctaggtggacccactgctttttggacagggaaagtacctggcagaagagaagctgagaggccccagtggctctctgccagcctggcacttcacggctgtgtgtgtttgggtaaatgtggccttttgagctaggcttcccagctgatagtctaagcggcagctggtaacacgtaagagctgctcacttcacagggccaccatgctgtggacctgggcacatgcccgtggcttcgttaacacgcttcgtccttcccagggcttggtggtacggatgccccacgcccactgaatctcatctctgagacaagagcaggactctgattttgcatttgttttggtttgtaaatctcctcctgtgagcttttatggcttggagaggctttctaggaggggctttctaggatggtgtgaaaaggggtgagcaaaggatattgacaggagagcagacagggaaggcatttccaaggagaacttacctggaaacattctagcaagcacaccgtgtgtgtgtgtgtgtgtgtgtgtgtgtgtgtgtgtgtcaaaacagacataatgtaaaatttaccattttaaccattttgaggtgtacttcacggaacgtaaaacgaaccatttttaaagtgaatagtttggtagcatttggtgcatttgcagtcttgcacagccatcacctctatcttgttccagaacattttcctcaccccaaagggaaatctcatctccattaagcagtcattccccattccccttcccctatgtcccggtgacccctagtctgctttcggtctctgtggagtctcctgttctgggtatttcatagacatggaatcagatgctatgtggccttttgtgcccggcatctttcacttagctgttttttgagtttcttccatgtcatagcgagcatcagaactttattcctttttatggaattttattcctttgtatatggtttatacaaaccactctgttgtatgcactaagtgaaaggtcctgagagtataaaggtgactgaggctgtgcccctgccatctagaggccatagtttagatgggaaacagaaaagatataaaaacactcatgtgctcagtgttaagggggaagaagggcagcccgcgtaagcaggggagagacgcatgtgcctagaggatcagagaaggcttcagaagaaaaggtgcctttgcagcgtgcctgggaagacggcaggccttcctgtgacagaagaggtctgagtcagcatggcaaaggcaccggggggccagccaagcatatttggggacttcgcagaagttcagtctgtgtagacaatgtttttggggaaaaagacggaaaatagagatgaggctgataagtgagttttgggactcctgtatcaggctaaggagattggactttgtgctttcaaagaggtttctgtgtgaaagcattgcatcccagttaggaaggtcactttggagagtgccctgaggatgggttttggtgggatgagaccagaaggcccagagagtctgactgaagtaaggagagacagagacaagggcgtgtcgccagtgatgatcatatccaggggcaggaacctccagttcttcataacccaccgaatgtttcgggaggaagaggagtgggattctttgaggatgagtcccaggttgcactcccaggctggctccgcagttagatccagatgatgcggctccccacaaggggaagacaggagattgcggaagacaggagaagcaggcgtgtgctgtgtgatgtttcgtttggttttgctcttggtggtgaaaggtggtgtggagaatgagggctgctttggatgaatggctgggaatgactttgggtccatccatgtggaggtgcatccaggaggcaggggggaatgaaagtttggagccggggagagaggctggagctggagttaggcacaggcccttggagagctggacggggaggaagcaggagtgcacatgagggaagctatggtgggaggagacaaggaagtcggtgaggaatgggaaaagactacacagtctagtctggaaaatgaaaggagaagggggctagccaggccaggggcacagaagagtttccatcatctcacacagaaggagtcaatgaggagaaggtcataaatagcaattagtgtcacagttctgagctcttgtgggttcatctcctcccatgcttatttagagtgtggtctttgttggtaaaaacattgtcttgtattgtcttccctcctccaatggactgtttcatatctgtagagtttccttctcatctgcactgtggatataaaaatggaaactgttccacattttggaaaggtttgtgatataaaatcttccataatatgcatcctggtaactaattaattttcacattgatgagtgacatcactgcatgactcttggtcaacctaaggattttacttttaagtcacttatgtttttacctttttaaatttcagaacttacccagattgaggatccaagagaacagtggaggcgagagcaagagcgcatgttgaaggaatatttaattgtagctcaggaggctctcaatgccaagaaagaaatctaccagattaagcagcagcggttcgagctggcccaggaggaataccagcagctgcacaaaatgtgtgaggatgacagccgctcgtacgccagctgtgagttgacttatctcctgttaaaagccattgtgactttaaaagccatctctctgctaggttacctgcaaacactgaaccttccctgggcaagatagcttcataaaggttctaatcgcatactgttaggtcatcagtatttggcactgaaatcaggtgggcacctggcagccactcctgtagcaaggatttatcaaatgcttactttgtgcccagacactgggttatggttggtggtgactaagaaaggaaaggtctctgcccttgagctcacattcaggtggggaaggtaaaaaataaacaagaaaacaaaatttcaggtagggatgtgtaccagctgcctgtctcatgcatgtcagttttgaagagggcttccctcagaaatctctgcagttaacactgcttgtctgggatgatctcttgggaaatccacacagtggcttcattcattctgagtgggaagactcaggagacctcagccatgtcaagccccctgtctctttgtagagttctcctcttgggctgtaggctttagtacgcagtacagggaaggaggaggaacaccatagaacccagagaatcggaggactctccttctgcccctcaggtgagatgaccatgtacagcttgctgttctctaaagggacctctctctagttttggaggctgccagagtggggggcttcatttcattagtactcagcaagtgcttggtgttgaagaaaccaggtccactctcagaacccaaagcattttgctgtggacacggtcagtcaccacatgagccagttccttcccagcagactttcaccctcaacagaccccaacagatgtgcatgactgtgactggcctgggcactcgtgagcttggaaagaatggatgaaagttggtaccactgggttgaattttataaaaacctgtctgtttgagacttggggcctttcctgtgatattagtgccatgttgccatggcagatattaaacacacagctatagctttattctgtgttgcaagtcagaatggaggtaaggctaaggggccacacgttttgtgctctgttttattgcggcaactgttgacggggcagaagccttagaagctatggccaggagtggggtattccctctgcaataggaattgaagatatttctatttccgtgtgtcttgagggaaacagggaactcagttttactgatgtgttgcttccaagccatcttatctccatctctgcagatagtggcacatacctggttggtttttttgagggctttgttttgtttttaacttcccatcagattgtgataggtcagctatgtgtggagttttagaggctggtttcttatcttcacagtcatcttttcttggaatatctttctctgattttggtatgagggtaatatactggcctcatagaatgaattgggaaatgttccttcctcttctgttttctcaaagagtttgtgtaggattggtattagtgctttcttaactatttcatagaattcaccaaaagagccacctggacctggagttctttgtggaatgtttttaactacaaatccaatacttttaatagagaggtatccagattttttgtttcttcttgaatcagttttggcatttgtgtttttcagagaattgtcttatttcatctaatctaaaagtcggcaaacttttctatgaagagtcagatagtaaacattttagactttgtcgaccatatgatctcagtgccaacgattctaccctgtagttatattgcaaaagcatccagaaacaacatgtagacagatgtgcctagctatgttccagtagaagtatcaaaacaggtagcaacctagatttggcccacagggagtttgctgcccagtgatctaagctgtcaagtctatgaagttgtttgtagaattcccttattagccttttaatgtctgtaggctttgaagtgatgtcctctctttaattgctgatattaataatttgtgtcttcttaatcagtatagctaaacttttattgatttttatctatctttacaatacactggcttttgccctgttctcccatttcttgtctgtttctatcttactggtttttcttctttattatttctttccttctacttagtttggctttaatttgttcttccttttctagcttcctaaagtggaaatttagatcactggttttagatctttcttacttcctcatatagccattaaagataaggattctcctctaagtactactttaactgcatctcataaattttgatatgctgtattttctttcagttcaaaataatttctcctttttttttggtggtttttgacccatgggttgtttagaagtaagtcagcaggactttttaaagatgtcatgttgttgttgatttctaacttagttccattgtggtcagagactatgtaacatttcagtcttttgaaatctattgagattacttttatggcctagaatactggttttttttttttttgagatggagtcttgctctgtcgcccaggctggagtgcagtggcacgatcttggctcactggctcactgcaacctccacctcccgggttcaagcgattctcctgcctaagcctcctgaggagctgggactacaggtgtccgccaccatgcccagataatttttgtatttttagtagacacgggattttgccatgttggccaggctggtgtggaactcctgacctcaggtgatccacctgcctcggcctcccaaagtgctgggattataggtgtgagccaccgtgcctggccagtctttttgatgaccagaagcccatgggcttggtgccttgatgtctccctagctgaagcattggcctataacctgttctgagattatatagttagcaattctaaacatttcagaaagctgcttggtagaagttgggttgaatggtataaaattgctgtttttgtatctagaaaagggctgaatattggctattcttataatccaacctaatagtgtgtttctttccagcagtctttgggtaccttatcttttacatgcttgcgtttggttaggtctccaaagaggctctcaaatcagtctttcaaagaatgaaatggaagaaatacatatcagaaaaacttggcaggatgtttcttgccagtgattgaaaagaaaaattgagaccaggtacagtggcttacacctgtaatcccaacactttgggaggccgaggcaggaggatcacttgagaccgggaattcaaaaccagcctgggcaacctagcaggaccctgtctctattaaaaaagaaagaaagaaaaactgagtctagagaaagtgtgtattatgtactggctaccaccagtgcagccaggatgtcagctgcagtgactgtggggaccctggactggatgccctcaatgatgcagacattagaacatcctgtctgattccacacccactctgaggggcagtgaacggggaaccccaatgcagtgccaagctgtaggttaagagtattcagtacttcagcatcctgagttgctaaggatcctgcaggatcaggttttgtatttccatgggcttttcacttctttgatgtttgggcaaatagggaattctactcaattacatttctttttgtgccctatgggattttattaatgctcgtttaaaaagatacactcaagaggctctttttgaagtggtatctgttccttcagtagaggaagctgatgactctgttgttgacttgaggttctaaggtgctcaccagattccatttcctgacctgctggatgtctctgtgtggatacgatctctccctccacttgtgtaggttgccttcgaggccaaaagtgggcctgcctgttttcgtgaaagggctggagatgccagtgggtcttcctggggcctgtcagctcatcagggaaaaagccaactctgaacggaatctaggagttgatccaagtgttttatcaacttgctgctgtccctagggctcccaccaagctctctcaatctgccatttaacccgaactaccaggtacaacaaggaaaaccctgctagagtggactcagatgaattctttctggccacaggataaagtccaatgcagtgattttgttggcttgaccatgatctaacagatggcttctacagccatgccagagggcctgggcccatgttgggagctgctggtggcagtttccatagcacacgttggctgtgtagccacacgggtctcactgcccagatctccctcagtgccagtcatctaaagcaggaggcgtctcctttttctgatactgtgaacagaataacatctggacttaattcccacttctttcttcatgggtaatgacttgaagtgaaaggaaccgatatccaatgagctggtgttttctgtgcattgttgtgatcacagtgttgtcaagcacgtgctgttttctttattgttcacatgagaaactgaatatcagggaggctaaattatttcttcaggattacatacccagcagatggtagaagttggatttaagcccagatctgtttgtgttggtggccttcagtgctctgtacggtttcctagacatggaagaggccactcagaacagctgatggtgtttgtggaacccctcccccatccaactttcaggttatctgaaaataaagactagttataaattgacaagttgtcgggaaattttgcagcaataaagggggcaagtggaaggcagagcactttctagatcttgacttttccatggcccatgtaagatcactaaactgttcatttatttttcgacagttagcacctgctgttgatatatactaaatggcgggaacatgttttttttgttgtttgtttgttttgttttgttttgtttttcgagacggagtctcgctctgtccccaagctggagtgcagtggcgcgatcttggctcactgcagcctctgtgtcccgggttaaagcaattctcctgcctcagcctcctgagcagctgggactactggcgcatgccaccatgcccagctaatttttgtatttttagtaacagggtttcaccatgttggccaggatggtccctatctcttgacctcgtgatctgcctgcctcagcctcccaaagtgctgggattacaggcgtgagccactgcgcccagccgggaacacgttttattcctaatggttgcttgttgggaaagatgaggcaataatgtgtgaacagaggaattaactggaacagccatttctaatgtgggagcagaaggtagggaggagaagtgcatctcacctatacccctcacacatttccctcgagctatggaaatcaccagaagaaaacttcatgcattggagaggaaagattttgtgtcagtattgggccatctggtatctaagaacatccgtgccttgacctgaaagcaaattcagatatttggctggatgctttgcacacttgtctgcatgagagtaggaacccaaccctgcttgatttcaatgagcttctgtgctagctgcctggtgatgcccaggcctcatttatgcttcgtagaacactggggtgaaactgctcaacaatggactcattctctctgagacacacctgctactttttctacagctccattttgtagagttttcttctactttctttattgcaacatgttcttctatttgcctgccttttaacactgaatacgttcattatctcagacacattttttcctggagttattcctttattcttcctgagaaactctagccccaggcacattcagatgaactatatatgaccatttgcaggatcttttggaagaaattcttgcatggggtaggataatagtctaaacctcaggtctgcaaactatgtcaagcctgtgggctggatcctatccactgtgggtgtttgtaaataaagttttattggaacacagccatgtccatttagtaacctatcgtctgtagcagctacagtggcagaattgagtatttgagacagattgtatggcccacaaagtcaaaaatatttagggtctggcccattagagaaaaagtttgctaattcctggtctatacccatagttctcagacctggctgcaagctagaatctttaaaaacttgctgcttggacctcaccccaagagattttgatagaactggccttgggtgggaccaggcttttttttttaagcttcccaggtgatccccagggttgaaatccactgggctagacagagtgtgaatggcccttgtagcagcaggaatatgactttgtttattatcctagttcctaggagttactcaaagtctacattgaaagtctttctgggtggctaggaaagaggcagcgttatctctggtgagaaagtgctgatccaccctgagttcttggattaggtggtggtgaagcttgaccttatcagccatcagccttgccagcattccttctgaggctccaagcctgtctcacaatgactcttccattggtgctctgtttttttttttttgtttttttgtttttttgttgttgttgttgttgagacaggatcttgctctgttgcccaggctggagtgtggtagtgtgatcttggctcactgcagcctcaacctcccgggctcaggcgattctcctacctcagcctcttgagtagctgaaactccagatgtgcgccaccatacctagctaattttggtactttttgtagagatggggttttgccatgttgcccaggctggtctcagactcctggactcaagagatctgcccgcctctacctcccaaagtgctgggattacagatatgagccaccgcacccggcctcattggggctctcgctgttgaaggatttctcatttgctgtctttggttaggaacagggctacaggcaatccattccaattcaaccttttgttttccttcacacacgcatgttggagcaggcaggagaaaaaaggatcatggagcatttttcccatgtattagtcagcaagccagattttggaggttgcagcaaagcacatgtgtttcctgagaaataatcccctagtctgtcctggagggagaattcctggttaggatttggtggcttcttgggttacttctgtagatcacccccaggtggccttacttgattgtttttggtcttttgcttatattgccttaaaaaaaacccatcctgcccgctttgttggccttgcgtatttctccatgtgcctctctggtagatagtacctgtcaacctggaacctgtcagggcttgtcggccttttgcccagagtcattcttggctcccttgagcaactcctgacagtgctgatccctggaggcctacacctggtcctaaggagcaacctgctccagaggatgtctttgaagaaggactgctggtcttttaaagcatgtcttgtctctggggtgaccttaggtacccatagctcagaagacgcctgtacataagagagacaaagacaaacagactcatggacacacacatttcccctttcagtaatctgtcaaactgaaatccagagttaagtactggggtttgcagcattttgagtcctaaatacacaggtcaagttcacctgttgggtggtgggcactggggagctggaggaccgtttcttcttctgggaaagctagcccaattaaaggatctttggcagctgacccaccggagcccagattctagacatgaagccctctatgaatgatggcataatgtattatagatcaagtcactacagactcagtcttttaatctataaaatgggcaaggacacataagtatcatttcaccttcacaaagattttatgagaatagattaaataaatgtgaaaggcaccctgtaatagcaaggtataataatttacattgctgtggtccagctaggctataaccttgttattatattatctgaggcaatgttgtatgcctgagcagactccatatgctatttaatagctctgcccacttaactcttcaagagagaagaaagcttcagaggtgaaagtctggtctttagcataaacctcgagattggagacatgtcttaatagaggaagatactccgtttataaatgttgtggaaggccgggcacggtggctcactcctgtaatcccagcactttgggaggctgaggcaggtggatcacttgaggtctggagttccagaccagtctggccaacgtggcaaaaccccatctctactaaaaatacaaaaaattagccgggtgtggtggcggcgcctgtaatcccagctacttgggaggctgaggcaggaggatcgcttgaacccaggaggtggagtttgcagtgagctgagatcacaccactgtgctctggtttgggtgacagagtgagaccctgtctccaaaagaaaagaagtgttgtgtagtacacgctattatgaggtctggagtcctgatctgttcttggactctgtaaatggttctagtagtcttattggcagatctgaggaactgagaattttatttataaatttaattacattattaaaagttatgccagtgttcacaaccatccttagtatttgaagataaaatgtattcactgtgttagttacttgagtagacttttcccttatcccagtcctggaattttataattttatagagaccatagcaaaagtaacatgaatgggatccacataattaaaaggtattctgtcacttatgatggtttcagctgcagcagagaagaataattctcatgggcctagacaataagaaaattcattgtcacatagcggagtcctctggaggtggggtgggattccccataggtggattcagtgactcagtggagtcattggtttgtcagtttccccctctaggagtggatacatgctgagtctcttggggagaggtagctacccaacacttccggggttctggtacttaggaaggagaaatgggggaaggttgccgtgtagatgtccaacagtatccaagacacctcccctgcgtatttcaagtctctttgctaattttccttatgaaactgcatagacagaggaagattggtacagatttttttttttttttttttgagacagagtcttgctctgtcgccaggctggagtgcagtggcgtgatctcggctcactgcaacctccgcctcctgggttcaagcaatcctcctgcctcagcctccttgagtagctgggattacaggcacctgccaccacacccagctaatttttgtaattttagtagagatggggtttcaccattttggccaggatggtctcgatctcttgacctcgtaatccgcctggctcggcctcccaaagtgctggaattagaggcgtgagccacggcgcctgaccggtactaatgtttagcattgcagtgaactttgttgaactttggtggtaggcttactttctacccttaatgggaaagatcccaggtgataactcttgggcttgtgttcctcccactgcaagttgacaagttgacacatgtgttgtagtgttgtaagccaggattcagcaagccctaacctcatagcctcatttgcatattatctctatcccaagtgaaagaaggcctttaagctcagatctgggaaacttaaagtcccaggagtttaatatggagatgttttctataagttatttctgccttttaaggacattgttggagatgttgctttcattactgattttaaatgaaaccaaagagtcaggcaagatggaagatgtaggatttggaaataggcagtcttgtctaagaaagaattgtttgtaaaatattttactccatgtctttgagagatcatgagtctaagtataagaaaattggagataaagttggcaaacatttagctcttccagttgtttatttccagtagattctgttgtttgaaattctgactgaatgggacttaaatagtagattttccatagaactgttattaaaataggagatccaactgctcaagtgaactttggatgtggttctaattgaggtttgaagtaattgtgctgttgaagctactcaatggtgttgagccatcctctgcagtacatagtccacaaatgattttgaattggtttctcattgttggcacctgagttatctgaatgacagccagcctttgattctcagatcaaaggcgttaaagaaaggactccgtccctgcagatgtgtcttctgagcaggtgatgttaatgacaatagctgggaggcagagggcaccagagtggggtggttcacagatgaagacagaccagcattccactagctaagcagaagaagggaagccatgcagcagtggtatagagcccatgccttcagaaacctaaagaaaggaggcagaagcatcaagaaaaagcaccgcagagcggtggatggggtggtagaaattaggaatagccactcgctgctccagcttccgtaacactggaaaaagcttgcagctctctgtgtgcacagaaatttgctgactgtgcctagcgtgtaaacagctctgtggctcttactcatccctaggtattggttactcacgataatgatgccatgtctgtaaaaagactttaaatcatatacactgcactgtttaggaaagcattgaggtatgtgatgtcttttagctaaacattcatcaaaacaaattattagagtaaaagcacgagtgcctcacttcagtttctgggacaaacaacttgggggcccatcttttttctcaagcctgccagatcctgacgtattactagaaatcttttttattttacaaatttctaatgtttttttcctttcttgtgtcaaaaattgttcatccggagaatataagtgtgaagaaaataaaaataaaatcatttttaatgcagccattgagaataactgcagttaactttttggttctatctttccagtgacgtctgtgtgtgtgtgttttaaaagaaagtaaaagtaggttcatactgcaagtactattcacgtattaagtacagtttcctatgtcataatcacacctcttccccctcaccccgtacccccgctgtgtctatatggtgtttaactgtagtagttttatagtagaactaaacagagttttgattgacctacagccatgtattttattatatgggatcctatagaaagtcctgatgcaaatatcaaacatcaggaagatttgaggatgttaaatgtcaattctttaggagccagtgaccacttgtaaatcagagatttagagtcctttaatgcagtaaatcagaagttccttgtgtgtatgtattttgaaggatccattataaaataaaatattttctttctatttagcattctctggatattcaacaaatacaaagtatgacccacaccaaattaaagcagaaatagcaagtcgtcgggatagggtgagtaaaaccgctgtttttacaaccaggtggacggaagcctggggccttatagcctaggccgctggtgttctactctggttgactcctcctggagggatcgctagcagtgttagactggaagagttctgagggttctgatgctcttccctggtgacccctgaattatctatgtgctaccatgtttcgtctcttcagacccttgtcttggttgtctgggaagggaaacacttttgttgcatttgggacaaagcacaagaaacatcttggcaatgaagcctgctcctctcttggtgtgtcattccctgaatcagggtgtatcttttagtgcagtggttctcaaattttagcacagctaagaaaaatacctgggagcttgttccaagtgcgagcttccaggcctagcccctgagttttgacgtgggcctggagcgggtcccagaatctgtttaaagaagcactccaggagccattgagtttcaggtagtcagagagctcgcttctggacacaaagtttcatgtgcggggtctgagaggagtgggtagaaggaaagatgaagaatgcgttacagaagttgccagctgtaatgtggaaaccttgaaaatgcaaatagttgctggttccccacttgcgtaagagtctgtcaacaatctgggatttttgtatctaagcacagcaggtcttctagaaaggctgcttcttatgcatgtgaatggaagtttgtagtgagaatagatgatcttatgaactgcaagctgagtagaaactcagatgacagtgctaataacaactgtagaaatcattcttcacagctggtttttgggaaaaaaaatgtgatttgtctttagctttccagattaaaacgagagctgacccagatgaagcaggaactgcagtacaaagaaaagggggtggagaccctgcaagagtgagttgcctggacacttgtcccaaagcttcatgcccttcactttcatgcctttatttatgctcatgattttccaatgctaacttcagaatctctcttttccttgaagatatttcgttgctttaaatggaaatacttgggaaacaagacctttatttttatgtttatgcacgtttactatagctgtgcaagacactcatggctagttacatttaaatttgactttttcttagttttagtcttttaaattttttgttctaaaattgacatttaaagtaaaagaaaattaaaagtttagtttcccagtctcagtagtcacatcagaagtactcagtagtgacatgtggctagtgcaggttttctccaccacttagcactagtgggatttggggctggatcattcttgtcttggggggactatcctatgcactgtagaattgtcttgtcttggccaggcctggtggctcacgcctgtaatcccaacactttgggaggccaaggcgggcagatcacctgaggtcaggagttcaagaccagcctggccaacatggtgaaaccccatctctactaaaaagacaaacattagccaggcgtggtggtgcatgcctgtaatcccagctactcgggaggctgaggcacaagaatcgcttggcgggcacctgtcatcccagctattcgggaggctgaggcagggagaatcgcttgaacctgggaggccgaagttgcagtgagccgagattgcgccattgcactccagcttgggcgacagagcgagactgtctctcaaaaacaaacaaacaaacaaaaacacaaagaatgttgtctttactctttacccgctagatgccagtagcaccttccacctgtattgtgacaaccaataatgtttctagacattgccaagtgtcccctaaagtacacatttgctcccagtggagaaccaccgtgctggtggctactgtattgaacaccataggtgacagatttccatcatcacggaaagctcctttggacattccagtctgtaggtcttcctcctgttctcatttttacaataagaacgttatccctactaagagattggggatgaattgtttacaattagtgagctgtatcgagtctgcaggtttcatgaactaaaggtggtgtttgagaaatggtgctggtgtgggtctgaaggtttgctgagccgttctctccattcactggctttccttgctgaacttgcgcatgtgccgcacgccttctgcacctacttttctcatctgcaaatggtgattgttttaggcagctcgggctgctatgacaaataccatagactgggtgacttgaatagcagatatttgtttctcacagttctggaggctggaggtccaatatttggttcctggtgagggcccgattcctgatatgcagatgaccatcttgtcgcagtttcctctcatggctaagagagcaaaaactctgttctctcttccttttcctaatcccatcatggggtcccaccctgtgacctcatctaaccctaatcacctcccaaaggccccaccttcaaatgccatcacattagagggtaaggctgcaacataagaatttggaggacacacaaacacacagtccataacagcaatcactgtgctcagttatactgaggacagcaccagcacctggtacatgcccagcccgaaacaattagtccaactctgtgtggttactgttactgacgcaggtgggcaccatgttgccgtctttcatcctgcatgcagatgcatgaggtgacacacgtgactgcagcactgctctttatggggaggtaataaaggaatgtgaggtacagatgtaattatctaccattacccagctatgtgtttgtgtgcattttggatctacagtcagagcttccttttattaaccctagttagtattagcacagcttcttctttagctttttttttttttttttttaagacagagtcttgctctcgtcgcccaggctggagtgcagtggtgtgatcttggctcactgcaacctccccctcccaggttcaagtgattctcgtgcctcagtctccccagtaactgggattacaggtgcccgccaccacgcctggctaatttttgtattttagtagagatggggttttgccacatttgccaggctggtttccaactcctgacctcaggcgatctgcccgcctcggcctcccagagtgctgggattacaggcatgagccaccgttcccggcctcttctttagttttgtcttaagcaaatcaagcttcttttccaactaaccggctgctggttttgtcattcatgcggtgcataggccagagtgctttccaaatgcaccgacgtgtgttttgtccttttagccccccactccagccagcctccagatactccaacacctcctcagatgcgactgtgtgtgctgtggcagtgtcatcctgtgtcactttggctaaggtggtggataaagaataagcagaaacaaatcatttgatttgtgacaggtcaccaaaagttattaggactacctagttggatttgaggtgaattttctaccttcattaggccacactgtagctgtctctcattgtgatacagtgtctctggacaatatgtagttgtttgtttttttttggtttttttttgagatggggagtctttgtcacccaggctggagtgcagtggtgcaatcttggctcgctgtaacctccatttcctgggttcaagcagttctcctgtcttagcctcccaagtagctgggattacaggcacacgccaccatgcccagctaatttttatatttttagtagagaccgggtttcaccatgttggtcaggctggtctcgaactcctgacctcaggtgatccgcctgcctcagcctcccaaagtgctgggattacaggcatgagccaccacgcccggcccagtaggtggttttaatgttagtcattgtgtgtgccggaggttgcagttaatgtcattctcatttgcagctctgaggaaggtgactggggttcaggaagagtctgagtttgctcaggatccctgagcatcagcagggagccacgtctggcacttccctcatggccatggtttctgtagtgggttgctgggctcagcgcccgttgctttgccttggctccatcgttctggtgaactccatttccttatttgaagacaaaggccatatagcagtgtcagctgtagatggactgatttagaaactgaaacgtactgctgactgagaaaacccccttctccttagcatggctaggatgtgaattcatcttttgtagttgcagtggtttcaagaataggaaaaggcagcctctgtttccctaggggcattagacagagaagcaggagccagaataacgagaattttaacttaacacctgcggccaaaacggagcgcaagttgtgctcctggaagagaggcgggccagtgctgtttggattgtctttctgctttcattatcaagatcccacgcttgggaacagcaattgtaaacttgccacttgccaaggggaggctcctcctgtctgcctgagctcatgagaatacccgccctccccctggaggccaaggagtggcctggggaaggctctggacctggccttggtcctgaggggcccaccccacctcatgcctgaccaggggcaagttagctttcaggagggagctgcccagagctgttgtttaatgggcacgttgccttggctctgtctgacgctgcgttgttactgtgcatgtttactttattctgggacagacacagcctcacaggaagaagagaaaacccaggcacccgtgccactcttaaaatatttttgtaagtggaagataatctggtagcctttctctgagttccacagcttatgagatgaaaacagcctcattatttttctggtattgaacattgggtgtttaggtttggattgaatcatgcaaatgtatatttttttaattgagaaattttagaaggccttttcaagcattgaaaatgtgattaccccatctctactgggaaatcctgactatacgtacagatagcaggtgagctgttatacctaaacatgaagcatctctgattttatcaccaacattgcttaaggcagtggcctgagattttcctccagaaaatttcctgctgttcttgcttcccagaatatccagtgtattcttttccagagcacctcactaggagtttggctgcttataacattttaagcttgccttgtttatcttggtgaatttcctggctagcaaggaaattcatcattacacttgggtccaagtaaggaaaaaagaaccttttgtattttactttaaatctatatatgttgttgattgttgtagagaggaattggccacagatatgttcgctgggttaatgatagaatatgtacacagatgtgtgttttatgtgtatctatgtgaagtgtacacatgtaagcttttaatgatggaaaatatcaaacacaaaagcagagagaatagtatactgaaaccttcctgtacccctcaccccatttaacctgcacaattgccaatcttgtttcggtggtgaccccaccccatctgctaagctctcacggccttattgaagcaaatgccagaatcccatttaatccataaatatgtctcctaaagttatggactccttttgaaaataactctaatccctgtaccccatttactaggcatcttgtgtccagtgagctcttgcatttcttcaggtgtttgggtccagtttgggccacagagtgcctttggttgatgtgtctcttacgtcttttcttttctactctccctcctttttttcccctgacagcttatttgttggagaaagtaatttggttgtcctatagaatttccctaatgttgggttttgctgctgaaattcacatgatgtcattgaacgtgttcctctgtctcttgttatttatgcaaatgggcgtaatagtttgagaggcttgatctgattcaagttggatttcttttctttttttagtaagaatgtttttaggtggtggtgttacttccatcaggaggcaccactctgtgcttgtttctttttgcggtgtgaagatgatcagtaggttctggccttgttagcccaatgctttgatttatattaataacatttcttgtcagctttttacctaagttatggatgtgtatcttccaggataagttcctgaaagcgggcttggtaggttaaagggtgaatgtatttgttgtattataggttgtatttcttatctgaaatgcttaggaccagaagtgttttgaatttcagtttttttttttttttttttttttttttttttttttttggtttggaatatttgcattatacttactggttcaatatccctcatccaaaaatctgaaacctgaaatgcttcactggtcattttctttgggtgtcatgtcaatgcttaaaaagtttcagattttgaagcactttggatttcagattttcagattagggatactcagcttgtattagatatggccaaattcctttgctgaggggttgcaccattttgccttcctaccactaacatatgagtgttctcgtttcctgtgactttgccaacaggatgtgttgataagcatttgcatttttgccagtctcataggtgagagatagtatctcagtgtagtttcaatttgcatttttcttgaggccttttataaaagtcttcagaaaataggagcaccatttacaatgactaattaaagtttagagaaaaattgagcttttccagtgaaaggtcccctggactctgttgccctaaagtttctgaaacgttttggaaaaattaccttactgtaacttactactagtgtccagaggcaaagggaagactcaggaccaggacacgtgcaatgtttcccaactgggtgatgtgcgtgaacggaccaagtgcaccaacagatgtgggcaaattcccctctccagctcctgcctggagctctagaatgtaccttgtgttagattttttttttttttttttttttttgagatggagtctcactctgtggcccaggctggagtgcagtggcacgatcttggctcactgcaacctctgcctcccgggttcaagcgattctcatgcctcagcctcctgagtagctaggactacaggtgcacaccaccatgcccagctaatttttatatttttttagtagagacggggtttcaccatgttgcccaggctggtctcgaacttctggactcaagccatctgcccgtctcggcctcccacagtgctgagattacaggcgtgagccactgcacccggccccttatgttagattctgagtggtcctgcagctgggaagctcatttaacattgcccttccctgagtttcctgctcgtgttattagagccttttcctgccatgatacctataatgtccctgagcactggcttgatggcagaagatgcttttgggtaacactgcctggccaccttgtccatggtgtgctgtttctacacccggcctctgatccttctcacagcttccaccaccacggctctgggccaagcactaatgtgagtctccatcctcacacagtagccatggggttcttccacagctagtgctctccttgtggtccttctgtggctctctctcacctacaacacaagccagactctacataggctggcccccggccctgcctcatttacctctagtttcacctttgaaagggatgtcctgcctttaccgtgggtacttggagctccctctgcttggaatgctctttcccccagattctcacatgcctgctcccccacttccgtgggcctttgcttagtgacatctcgagagatcctggcttaaccatccatctaaaaatgtactctgtcacactctatccccaaactgcttcatttttttttgaaaacatttgtgactgcctgacctaaggatgtacttttcattgtctgtctccttggctcgaatcgtgctgcacgaagacaaggacttggctttgttcgccgcttcatcctgaggacccagccagttctcagcacagggtggggcttgggagtgaatgcagattgcccgggtgctggggggagtggctgaggttgctgttcctgcccgctagtagccatcacagggtccacttctttctcggacactgggacactctgagtgagggcagatgtttccttggccaaaacttttgtccctgggctggaggaactcagggaggcctctagacattgtccagtcaccttcttgccaactgtcctctagcacagcattctcttctgcattttgtgtgatattgttttggcctgggttttaagaagtcctattatcactgctattcaaatcacagaaagggatgctcaccagatgttccactaactagtttccatgaggtacattcttagccactaggtgagcctctgcttcaagacttttgatttcttgattaacttcccaaatggggtgaaacccatttgtctccttaaatatgagccactacatccttctaagcatgcaataccagaatgaagcattactgcatattagaattagcattttctgtctgaagggatttagtagtttcaagaaagagtgggattgttcagtagaacaggcttaaagtaacaatctcccattagcgtagcacctaaggaacagcccacgcgaaaacctcggcaatgctcagataacaacagcgaaacgtacagaaatgggctggaaacaaaaagaggattgttcctggttgtgggacaggtctggtgttccacacaggtcttgctgttgatagaaagccgccggaagctttctgaggttcacccaaggccgtctgccagagctgctgatagaaaatgtagaagttgtaacaaacctttccattcttctgggttgtaatctgtggtattaacacagaatatctttagagggctggcagctctttccttcaagatgtggggttaagaagttatgtggttttactcttatttttcctagtgcagttctcttgacatcttaaattgaacaaccaatatggaaattttagggtggcaggaggtagaggttgacaataaacatctctaaaatgccttttccattgtactaggttcctcatctgaagctgtatcttcttcttttctctccagcccatttctttcaaaagcacaccataaagagcaccagtttactttgggatgacatttgactggttatatgggtggccttcaggtttgacacaatgggcatttagaggccttgactttgaatatattgcgaacctggtgatggagcagacaagtcctggtgtggggggccttggctgtgaacttcactttgcctgttactggctgtgtgaccctcagcaaatcacttaacgtccctgaagctgaatgcaaaatgtagagggtgcaaaagtaaagactgtgagtctgtgcactgaattttgatttcatactgcataataactcatgtccttgtttagtctccttgagcagttaccttttctatcattttatttgtgatgtatggtaaaggcactgtcttgcactcttaattaaaattaagaccagaataaggcagttctttggcagtcacagatcttatgattttttaaacgaactggaatacatcaatatttttaaaaaataccaaatcattgagcacatcatctacattggaccaaagttttttagggaagttttagagagagagagtgtgctctcaaataaatgaattttacagaagtaaaagaagacatttactgtcctttgaagtttttgttggatgaaaatggatcacaattgaaaaaatggaggtgttgtgaagctatgacagctaagaaagtataaggtagcccttccatgaatatcccagtgagttacgagcagtgagtgagaaggccagccattttgatggaagtggggctggttttgagggacaaacaaaagagttttgaaaatgtacaatgggtttatatgcctactgtcaccattcttgctattggctcccacgttttagtagccaccaactggcctgctggtactgtgctgggaactttttctattttattgccaaatctcccgaggaccctcaggtgatgtagactgttaaagtttaccaccttgatcatttggatgaactgttttgtgaaagaagggatttaatgagagcagaataaaaagaaaaaatatgcccacagctcaaactttagttcatgctcacttattttaacttttggcatggaatactctatagttaaagatacgtgtaccttttaataaagatgtataaataaagacttctgctttgtaggaacagacaaggcaatgtgtatttgagaaacctacaagtctgtaacagccattatggaagtgcctgcagggtcaggacacgttggcatttaggagtgtcattattcaccatgcacggtgtgcctctatctgctctcctcggggcagaactcaggactagtgtttataaatattttatttgtagctgatggcaatcacagcaatgctgccgagccccagagccctattcaaagggagtcaatggcttcctgcttgtgttgtttgccctcttcctaggccatggatgctgatagctcaggttgactctggtgccgagttttgcttgagttgtgacatatttggcaaggaatttgttaatgataataaaacaccagagttggcaagttatttactttttctcccatgagtaaggagattctgtgttatcctgataataacagtcaccgcaaacaccatatgccaggcctcctgccaagcaagctcttaccttgcattttctcattaaatctcatgcccatcccatgggagaaatatttttagtgtccccatttgagacaggaagaagcaggtggaaagaggggaagtgactcacccaggtcccacagccagtgagtggcagagctgggtgccactcgcacccaccagcatgccagaggttcctgtgagcggtaagcaagggagttggggctggcagttaatgatccaggttttcaggataacatggagggaaatgttagaaccagaacctgtgaactgggagactcggaacctgaaagaagccagttgctttccagagaaggaattcattccactctggaccaaaatttctcaagttccttagccttagggcttcccatgctggagcctcaggtgtaggggatgtgacaaaggacatgctccagaggccacctccctttgaaggcagaaccaagtcttgttttgttctgtgctctgcgtccagccccagacccaggcctggtgtgtacaggagctggctgggaggatggaagcttggaggaaaggtgggaggaaggggaggaaggagggagggagggacattgccattttccctggatgagtgtttggattgaaggaaagaattgaggacttggtaggagaaagagtgagtaataaattagaaccagaatgaaatcagagttataggagacagaaaaggtttccagcttttgtacaaagcaccattatcgaaagctcactacttcttgctgtgtcccatatattctccctgtacacagatctcattcatatgtttatttaacaaagattttgaccactaacctggagataaacaaaacatgtcctcttttcagagagaggaatttacagtctcgggaaattactcaagcaagcaatcttgttgcgcaatcattagcggaggacgtgggcatcctgtctcggacgtcttcacctgcccagggtgctcctgagcaaagggtgttgtatcgaccagaaggagggacgcttccgtggggtctttctttttcttagccaaaacattactttaactgtttccacctctctatgaagcttttgggttttcgtagttgtatgtttaatggaatgctaggatctcatgtgaaatgacattgatttttctgttttaactaggattgatcggaagatgtcaagtactcacaccagctacaaactggatgaggcgcaggctatcatgagtgagctccggaccatcaagaaggccatttgcacaggcgagaaggagaggcgggacctgatgcatgtaagctgcctgcctgctcatgtgttttattttaagatgtttttaatatacttatgtattacatgttatatagttattgtatatataacatatatgtgtatataatacacacacacacacacatgcatacatacatacgcaccccccactgtatttaagtacgtatatagtcatccctctgtatccttgggggattggttccaagacacacccccatccctcaggataccaaaatcattggatggtcaagtcccttatataaaatggtgtagtatttgcatataacctgcacagtcctcctgtatacttttctttttttttttggagacaggatctctgtcacctaggcttgagtacaatagcacaaaaatggctcactgtagccttgacctcccaggctcaagccatcctctcacctcagcttctagagtagctgggaccacaggtgcgcaccatcatgcctggctaatttttatatttttagtagagacagggtctcaccgtgttggccatgctggtctcaaactcctggcctcgagcgatcctcccgtctcggcctcccaaagtgctgggattacaggcatgagccactctgattgctgcctccatggtcacatgactgtctctttgtctgaatttcctgttcctgtaaggacaccagccattggataacgacccaccctaatccagtatgacctcatcttaactagattacatctgtaaagactatttccaaataaggtcacactcacaggttcctggggttaggacttgaacatatctcctgggggaacataattcaacccacagcaatgggtgatacatttatattgttcaataatcaagataattccaaaggtctatgataagaagtctcgctatcgccccatcctcctactgcccctgactgcctttattacctttttgcctacccttccagcattcatgtgggcacacaaaaagagaatacatgtttagccgccctcacgcaaagccaggactgtgatactgttccgcactagcttcctcacttaacagcaatatcccctacctttccccatatctgtacacaaagagctgcttctttccttgagatggttgcatagtattttactatgtgggtgtatttgtattatatatagctgggatcattgtagctttatactgctttatgtttttttccccttgagcttttgtagtttctgttatttttagaaaaagttgaacttttgcaaatgcaaaaagctgcctccatggtgggaaactcaagcaagacatctgagtggctggccctagtgctgcacatggtggcctcagagaggccaaggcaggggagcgctgcttgacctcatgacgtaaagtgctggaatgcattcagtgcttttggttacagcttttatttttcatctgctaccctaagtgagcacctactgcctgctggcatgtgtctagattctgtagagtataagacccacaggacagaacaagcaaagctcaaactcataggcaaaatgagacagatgcacaaaaaaactaccctgcctgggtagtgccttctaaggtcaaggccatgagggacttgcggagagtcctcatggtgcttgttaagatgcagattaccaggccccaccctagactcactgaattagaatctctggaggtagggcctaggaatctattttcagatgacctctccaggttgtgataagtaaatggttaattgttagattttttttttttttggcacacaggtagcactgagaacagctaccatttattgaggtctctgctcagctgacatcaaacaagatgccccatgtttgttacccatcgtcaataccgcaggctgaaccatgtggtgttccatggtggagacacagaggctttacgccatgaggccaagcagggctgcctgccccggcctctctgaggccaccgtgtgcagcaccagggccagccactcatttgccttgcttgaattcccaccgtggaggcaacagatagaatttctggaagaagcttcaggctcgagcaccttctttgacgtctccatagcctctcaaactctgagaagctccaggaagaggcacaggcagagtcctcttctatccaggttaaataagttgttttgcctttcttatgtgaacttaacaatattggcccctcccaagaaggccttatctcaatctcaagccagttttgtgagttctactgcacttgggcatttttggttctggtgtctgtagtaaaatttgctgaaagtgaatatattcagaagtctaaaagaaatggtcaaaaatctgatttctggctgggtgcagtggctcatgcttataatctcagcactttggggggctgaggcaggaggatagcttgagcccagaactttgagaaaagcccaggcaacatagtgagacctggtctctacaaaaacaaacaaacaaacaaaagtttagctgggtgtggtggcatacctgtagtcccaagtactcaggaagctgaggtcggaggatcacctgagccaaggaggtcgaggctacggtgagctatgattgtgccactgcactccagcctgagtgatagagtgagaccctctctcaaaaaaaaaaaaaaaaaaaaaaaaaatcagaattctgatttctgcttaaaactgccacacagagagatttcatgtgccagaatgcatactaactctaatttttggcaaaccaacatacatatgagattacttttgaccatgtagaattatgactgagaaatgaggtttataaaaatacgtaagctaaaacagcaactcaaagaactgaaaaagaaatacgtaagcattgtctgggagctgttttccccttccctgtttttcctctgtaacaatctcaaggcagcattcatctctgtcaggctcatttacattttcgatagaaatacttatttttttctttaggaaacatgaaggtttaagaaccagtaaaaatggtaccataattgtcctctattttattcacatgctgccagggggacttagttgcgatgtgatttaaatgactaagaattttattagaggtgcctgtgatgaagggcatttatgtgaaatctaacgagcatgggggtgaggtggggcaactgttcagtaataaataatgcagcagacctaaaacaaatgagagaaccacttctggagggaagagacacatcaccatctccgttcaaagagcttgtctcattgtgttccagagcctggccaagctgaccgatagcttcaagaacagctgctccgttaccgactctctagtggacttccctcaccatgtaggcgtgcctggcgatgctggtgtaccccagcagttctgcgatgccggctcccagactgatatcatcggggaggtatatgcgcgcccagggggagaaatgcaccgggagaggggagggctgcttcagtgttgccatcactggtttggtgtaattttccatgttcacttaagaaatgccttcacttttgtgccattaagtttgaagaaaaagtgttgtgtctcacatccagctgtgtgatacaattgaattgcttattactgctgcccttatgatttggactcttataaatgacatactccttgtgagagttgagtttcactgttcttttgacagacatatcactttttagagcatgagtccccacgctttttctgtgaagggccagatagtaaatatagtcactattttaggctttgcaggtagttctgctggaactgccccaccctgtcattgtagtgtacatgcagccataacagagatgccttgcaagcatgtaagactggggcctcgagctgctcaaacgttcacttacggaacagccagtgggctggatttggccccagggccatagttactgattcctgccttagaccactgatttccaaaggctttatagctgtgccaccttgggtgttactttattgctgtttcttactcttctaaaagaatgtcaggaaattgaattgaactaaaagtcatttttgtttgagacttggaagaatgtcataatgcctcctttgttaattagcgaagccttgagttagccacaaaaacaaagttgggaaaatcaccatttgaagcaggatggtggatattcaaagacgctagtattgtaatatcattgagtgaagcttgacattaatttgttaccaaatggaaaaacagtttaaagagcttctttttttttttttaaggattattaagtaaagatgaggtatcaatggaatgcacagtgccacccctcccccgaaattaaataaataaaaggaaagcaacaaaaggaggaaaaaacaattgatggaaaactctgggttttaaataattagctaattaatattttgaaatcttagcaactagtgcctcttcgagtggagtataatgtaggaaatcacggccctttatgtcttgggtgtcctggaacagtcctattttcaaatttgcctgcgttgttccaaacgtacacttggccgtttttgactaggcatcttctttggatgaaagaatatggtcgccatctgtaacacacagaggagaatctgtaattcaaaaatgtttggcatttttgcgtaaagattttggagcgagagaaggaaacaagtgtaagactcattgaattcgtgaataattcattgctgcttattgtaaggttagaattagaatttagtttgagagaaacagttaagatagaaggttctccagtgatttaggtcaacccttctaaaaatgtcaggtgaggagtggtggctggttatgctacttgagcagtcactgctcattgttgataagctcctgaagtttaccggggctgaccctaggtcagcaatctcatagctgttatctcagtttaagtagttgttcccatcctgtgtgatgtgcaggagaccgagatgccaggttacctaaggtcttgtagctgaggagaggcaggtctggttttgaaacatttctcatccctaaacccctgtactttctaagaaaccacatcatgttatagaaaaatagatcaaaaggctatgactgtattagctaaccattgctgcataacagatttccccaaaacctagcctcttacaacaacactcctttattatctcatgcttgatgtggtccaggagactgggctgggtcttctgctccagggtctctcaggaacttccctgcaatcaaggtgtcagccaggactgtggtctcatccaaaagctcacctgggggaggggccactcttaagctcatgtgattgttggcaggattcagttcctcacaggttgctggactgagggcttcagttccttgccacatgggctgctccagcacggcagcctgcttcgtcaaagtgtaccagctgagagtctgctagcaagatggaagtcacagtcttttgtaacctattcacagaaatgacttcccatcacctttgttctgttctattggttagagtcaagttatagacccagtttattctcagggggagggaatttcacacggggagaatcccaggaggtgttggtcattaggggccttcttagaagtctgcctacctcactttgtgcttgtgttgagtctgttttgtggggtggatattgctgtatgtcagatgtgctttttgagactggagatttgcagccacagggttgcacacgctgtagcgctgcataggaactctgaagcaggagtctcttggatccatttggctgtcttttcttttcactaaaatgtccatttaattctcaaagaagagtacagaaacaaagcttagagagaggtgcatacagctttgagaagaggtttgagagatgatgtttactgatcttgatgagttgattgcagggtcactaataaagaggggactgaaatggcaagtagctcatctccactgtggacagcttttggagctgtggcactgccacttaaatatatttatactgaggaagctggagaggagcattggatgaggccgtttaaacatgtataattgtggccaggcacagtggctcatgcttgtaatcctagcactttgggaggctgaggtggccagaggtggccagattgcttgagcccatgagttgaagaccagtctgggcaacatggctgggcaaccacctgggcgtggtggctcatgcctgtagtcccagctacttgggaggctgaggcaggaggatcgcttgagcccaaggggttgaggctgcagtgagctgtgattgtgccactgcactctagtctgagcaatagtgcgagaccctgtctcaaaaaaagaaaccatgaacaattgtcattctggttggagaatgctcagtcccttgtaaggcactttttcatcttgccattcaaggcaataaatttgcgaagacatttttcatcaacatagatcaaaactcgtgtcgataaattcactgctaatcattcaagttgaatattttcagatacttgttgatgggaagttatttcaaaaatgtaaagacttggtggccataatatgtgatctagtaaggtcagatcaacagatggagctgatttattgaaactggagttgtgtgaatatttgcaggaatgaggaattaaccaaaatgtactacagttacttcctgtacatgtctttttttgttttgtgtaggattttattgtcatcaatgtaactggtacaaaaatatttaagtatatctactcgtcacagagcaccgcatttaggctaactctatattggtactccccgagctctggctttttgagaccttgcttgctttccttttgcccttggttctttttttttttttttttttgagacggagtcttgctctgtcgcccaggctgaagtgcagtggctcagtctcggctcactgcaagctccgcctcctgggttcatgccattctcctgcctcagcctcccgagtagctgcgactacaggcgcctgccactacgcccgactaattttttgtatttttagtagaggcggggtttcaccgtgttagccaggatggtctcgatctcctgacctcgtaatccgcccgcctcagactcccaaagtgctgggattacaggcgtgagccaccgcgcctggcttgcccttggttctttaacacacctcgtggcatcagaaggcgtccaccagcccatccgtcacacagctagtccagcttcctcagaccgtggagcttctgagtagaacatcattattttacgtttactgaggaattagagaatgtactgcacaaaatcgggtgactggtttttgcctttgtatcaacttttactaagtaatttcctacttcttttaaaacctaatttgtggttgttgtttggaattacagaatagatagatatgctgctgctgtaaaaaaaaacaaaaaaccctaccagtttaggcaagcaagagtcttcccttccccctcccccctccccagccaggggtggccgcaaagggttattcagtgtttccttccagaccttgcacagattgaaagtgaaagagatgaagaatatttctcattgctgccgaaagtttaagtgaagttgctattttggaaatatgtttttaatatgcgtttcctttctttttttctctcttctgttccggaaagtttgtctttgatgataaaacaagacttgtagaccgagtcagacttaattggcaatatgaagaagccagaaagaggtaagaagcacttttttccaacctcgccttctgcttacttacttactttctcctgtggaaggaagcgtggcatagttcctgtgtgtgattggtcacgtctcatcggagaacagcgtttgatagaataccaagtcaaggatcttcatttacgtgtagcttaatacatacatatgacaacatttcaagtgcatttaaaatgtgaaatttgcaatattacaaacagttatacagacgtgattccataagaatagaaacttttttggctttgtcatccccggtggttcagaacctctacccctccttcccttccctccttccaatagacgagcatcagttccagagggtgtcataagtgaaaccacttgatcttttatatgtgtggcttctaactccataagctaatgggcaaagccatgtatcttggttataagacattcaataagcattaggtcaacaggtgagcagtacctaattgatttcattccatttatgttgtcctgtgtcgtaaaccattggcctcctgcaaattgcagcttgacccactttgtgcacttgtgtttctctttcctcacttccctccctcccttccagtcttcatcctctgacatgcacaaagctgagaggcttccgaaccctcgcatggcatagtattttagggcgtcacgtgtctcctcagctgtgcagggctcccgttttcaatattcttctcctctctgacttttgtattctctttttagggactttctctagtttgtgccttctggaaagagtcttaaagccaaattatttccaaataagtgcttcagaagagtatcaagcatatcttttttaaaaagttacttgagtcacaaatgaaatattgtcatggggggcggggagagcagaatagcagaatgtcgggtggggtgagggagttctttctggaagctaaacagttaggcctgctcagcacactgtaccattcatggacgtctggaaagctactttgttggctttttaaaaaatgtaaaaatagcaacaaaagcacatcatatgattcagtgctccagggccaacttaaacggacatgggccttctgttttctaggaggttttctaaccagtgcctcttggctttttaggatggactcgtggtgggctttaaatttccccacagaacagtgccaagttcatttggcaataccagttgtctgtgtggtgattcttcattatcatgcatattccttctctgtagcctgcaagagtttgtgaggagcgattgtctcttctgagtattcgtctgctcttgcctgtttctggtgaaactgcggagtgtgggtgctggaatttgctacacttaggaacatgattgttacgtgtttggttgtgacatttaccaaacatagcaagtgatttctttgttttctagagatggtgccagtatatggtgagtaaccttctaaatgttgggataatacatttgggtgaaaagtcgagtatttaagaaaattgttcaaggggcaggcatggtacttcatcagttcttttgaataaaataccatattatttcaagatggccagaaccttgttaggaaacgcaccacagctacagaggaaggtccaccttccactgacagtagcggcatgtcagaagtgcctctgtgggctgtgttggagcatttaaaaatcagagatttcttttaaactccacctgggtgggcctgcacaggtgctgcctgtccttttcccactagcatagtggggctccacacagggagcaaggccttcaccctccaggagacctccagcagtgtctgcagacatgtttaggtgtcccaactctagggcaggggccagggaggctgcttgacatcctgttgtgtacaggatggcccccgcagcaaagacttacccggctcagcatggccgcggtgccaaggtccagaaacctcgccctggggcttcttcctgtcttgctcctgaatcttcacgatgcatggacaacaaggggcctacatgagcaggtcgcctgctgactcacaggcatcagcctgctccccactcaccctgctccagccaatcggcccctcgatgttcctcagatgtacaagcacgcctgcactgagcagcccctcgggcctcccaccgggcctcagtcccaccgagccaactcctgacctagcatctgcagctggcagaatgatggtccgtcaaggtgtctgcatcctgatctccacagcctgtgaagatgtggctttccatggcaaaagggacttcgtggatgtaattaaattagggatcctgagatgatggggaaatgagcctatatgatccaggtgggctcagtgtcatcacaagagtcctcataagagagagacaggacggtcggcagtagagaaggagatgtgaggttggaatcagagatcagaatagtgtggggccaggagccaaggagcacgggcagcccctagaagctggaaggtgcaaagaaacagattttcccctggaacctccagaaagaacgcagccctgtagacccattttcgacttctgccctctagaactgtaagggaataataggtgttgctttaagccattaagcttgtggtaatttggggcagaaaagagcaaactcatacagtgcccttggcctgttctgtcttctctgtctggaatggggtggcttttctccaaattgtcacatgacctctccttttgatcaccttgttaagagaggtttccttgaccatcctgaataaaacctcaccaccctgtcctcaccccggtccccctgattggctgagcaaatgttattacctaaccagtgtttacttttcttactgcctgtctctccctgtgaaaatgtaaataaccctcatgagtgcagggattgtaggtcattgctgtaagcccagcagctacatacttggtgaatatttattgaatgagtaaatgagggtcccgtgtggttgcatttgctatttggcctttgcccctgggacggggcaagccagggcagtcccggggccaggtcagctccaggccaactgctctgctcctgggtcccttcctcaaacctccatccaggtgtgagccttggggtctctcgccttgacttgagaagggaaagggcttcaagacatgggtgcctttagggatctgaggtaggcaaggaactgtctctccctttcaaggactatgttcaaggtgtgatacgtcaacacaccgagctagactaacagttctgggccttcatggacattcaaaagggctactagcctttgaactccataattaatcctctccttgggggttggagaaaatggcattggagttgggtcctgaaggagtgctgggattccagtcgccgtccattggggatgggctttctcaggtaagagtgggggtcaggagtgggggtaaggtgtcactctgcagcagctggactggcctggaattgcagagcaaaggccagccaggctggaatggaggatgcatgagcagggaggcaggccacggcatgggggccacgatgccccgaagaggggtcagaattgctgggcatgctgggacgtttgagttggaaagattaagtgtgagccattcagatggtggtatgtggaggagggccatttgaggaacccagatggcatagagatgaagtcaccgagcagctgggctcaccttgggagatggaacacagggagaaaagaggagatgccaggactgagcctgaggaagtccaatcaaaggcctggcgaggacgagactggccagaggggtgtagtaaaaggtccgagaggggatggctggggctggaggaaacaagaagaggaagtacacctgagaagacacttatgtccacgggcccagtggctgtgaaggaacgaaaagggggtggtaccgttggccgacaggcaggcctctgcttcccaagcccagcctgaggtgtccttagtccacagtgcatgggaaaaaggagggccagcggcaggtgttcctaaagccaactcgctgctttccagtcaaagaagcctctcattctcagagatacatacatatgtacatacatacatataaatatatataattaatatatgttttatatatatttaatacatatttattgtatatttttatatattatatttataatacgtgtttaatatacattttttcatatatatttttttctgttaaaacatctttctcttaattaactaatgatgatcattgatgtgaattggttttttccaaaagtctttacttggcaaaataacaagctggcagtcctaaattgttgccatcagcacatcccctttcttaaattggactggcctgggggaagtgtgactgagatggtgctctccctggaattaaaggagaaggatgaccctaaacagggtttccagaggctcacagtaaagtggagggtcatttgaaaggcagatcttggttttgaccatgagtttggtgttttcagtggacttgaagctgctgagaaacatccatgaagtgttcttgtcggtggagtccgcagtggagattgcagttcgctgagtcattgattgcagctccctccgggctctggttcccagatgcggcggtgcacgtctccagtccccttggtgtgattgtttctgcctccagtcattccacattggttactgtagctaaggcttgaccagtaagtgcatgcctgccatgtgaactactcagctgtaggtcacataacccttagcagcctgggcaaggccctagactttacataccttgtagcgttgtcaggatagtcttggctcccctctgccccatccctgtagacagatggaaggctaggaagggttgatgttatcaggtctccccagcaccagatgagcgatttcattacaatggtgttttccgagtgttctgatggactgcctctaagtgaggcacgagagtagaacgatacagacttggggagagagcagtggcaagtggttctctggcaagaactcaacattaacattccaggagccaggtgctgagtaccacaggcaaagcatggtggctttgaggtcccgtccatggtctcttcctcggcccccttgatcaggctgggagataatgtctctgatatccctgtgagcgtccctggagaagtggtgtgccatgagcaggaaggcatcatgtacccccatcaacccaccaaagcatgaaaaagaacacgttgctcttagtggcagtgttagcaaagaataatgcgttcttccctgctccctcattccaagcctaagggacatcatgtgccctttcctcttgcccaggtgaacttctattagattagtgccacaattcagtgtcgtcttttcgttctgctacttcgccgttggacattaatctcccagctctcattcctgaaatcatttcaccctgcaagcttaccttccctactgtattaggttctgcagagaaacagaaccaacaagagtaggggtagggaagagaagggagagagattattttattataggaattggctcacgcaattatggaggccaggaagtcccaccatctgcaagccggagacccaggaaagccagtggtctcattcagtccaagtctgaaggcctgagaactgggggtggggtggggtgtggagtggggtgggtgggtgggtggtcatagtgtaagtcccagagtctgaaggcctgagaaccaggagctttggtgtctgagggcagaaggtggatgtcccagctcaagaagacagacagaattcacccttcctccacccttttgctctattcagtccctcaatgaattggatggtgcccacccacattggtgagggtggatcttctttgctcagtccactgattcaaatgcttatctcttccagaaattccttcccagacacactcagagataatgtttgtaccagctatctgggcaagctttagcccaggcaagttgacacacaaagtaaaccatcatgtatatcctctgcagaacctcctgtgctttgccacttctgaacagtggaggattttatgccttaggcattttggacgtctttccttgcacatatatatttgagattatttttaagatgtgggaaattgtcaaaaatgccgaattctggacaatgagggatttcatatatatatatacattcagattttttttctttcctttttttttttttttttttgaagacagggtctcgctctgtcacccaggctggagtgctggagtgctggagtgctggagtacagtggcgtgatcttgactcactacaacctctgcctcctgggtttaagcgattcttgtgtctcagcctcctgagtagctgggattacaggcacgtgccaccatgcctggctaatttttgtatttttagtagagacggggtttcaccatgttggccaaggctggtctcgaactcctgacctcaagtgatccacccacctcagccttccaaagtactgggattacaggtgtgagccaccccactcagctggatttcatatatattcagatttaaaggaagtttgtggaagtggaactcataattctgagtggtgatgtgatttctagagaattctctggccaaacgaccactatcatgatgactagttttgtgtttttaactgtgggtcctgtgaagcgtaccaaaaggactgcttgcaccttgcctcaggagcgcctcttcggattcccaaggcagacctaatgataggaatattcacactattgattttaaaatttcagaaattttaaaagtgaagttgaaagagcaagtcttcttgaagcaatcccgatgacgcagatggctccttatttttaacttaagggcgcttgttccagaactgtgcacaaactgtagctgttaccatagaaacactctcagtccagataggaacaaaacattcggtccatccagtttctctgcctcttagtttttgttgccaggatcagtcctgctgttcatcagttgtcgaggatcagtgtagtgttatgattccagttgaatttgatcaatcacttggattttttcatttctcaaatgacttcctatctgggttttaggggtggggcacagttgtgagaaataaggaaaagcatctttgccactgtggctctgtcttccctattctggtcaacacggagaagcctgtagactcactgctttttatttgatgaagttgctctctgaagatctgtctgttgcaaagggagaagatgtcagggctgggaagctgaggacggggtgagatattggtgtattagtagacctttcttatcccacatattctagattcagacttctcaaacttctgacataaagagttgagtagaatggacgctggtttagttcaatcagctgaagtgatttcattgtccatctgacttacatctcagctgttttctttaacctttgctttttatttaaatgggtatttacaacaagaaaactaagagaaaatgtaaggagtatcgaacctgtagccgtaattgcaatctgaaggtatgaggctctaagctgaccccgcgtcctggaatgtgccattgggatccctcacgactcatcaccatgggataggaccgtgggctgtccagagttctgcttgctattccagaaagcagcaggattttaggaccatgagaaatgatattgtagactgcagatttttggtataaattcaaataattagggattattcttgatatgcctcagaactttttattattgaaagtgcattgttttcctataaaaatgcaaatcgtatttaagattttcatgtgaattgtgagagtctaaatagtttctgcggcataaatgcatggtttaatggtgcctgggttgtaacagaaaagtgtttgagcaaaaatcataagggaaaaatgattcatattttatgtctgtctacattagacctgctcagggaatagaatttgggaaacacataataaataagaaacctgcatgcttgattgaacatttgctttcttcactatcaggacacgggggcatatattttaaggcttttaaaggcatttgggagagattttatataggccataaaatgcattacccctcaaaaataaaaatcactgaagaatatagttggctcacagaaaaaaaaaaaaatcctctctaattttaagctgctattagttctctttacaaaaaactcgggaaagttattttgttttgcaaactttaaccatgaccttgctttacttccatgtatttaatttcactgaaatgatatttcaaagaaaagcctttctggaaattgtttttcctttaatacccaaaattggaacaacagcactcacaggagcgaggctccaaccagtggatcagctgtttggcgtggatgtagaagaaggtgcattgaaactcagtacatctgtgtttagccttaggcaggaagtctgtttcttcaagtaaacctaacgtactaaagatactccctgcagatggctcgtttccggcccacggcaaggtagacaagtcatacggttttaaaggcaaagccgtcttgtctgtctcatggggacataagaacaatcgattgttgaaggaatcctagtgcttttggcttccagtacagacagacagacagatgtgcctctctcgaccttgctgaagcaggccccaaatgttcacacctagaacatggggacaaagaaagaaattgaacttttcaatatgttccagtttcttctagattcatatatagctctgaaatgaagatgagattgtttgcattgttgcattgttttgaaattttattattaaaccccacaattggaaggcacagaaatgtttgcctagcattcagcacagcccaaacatttccagatgggttgcagattttgtttctgctggagaggtcgtcccttgccgtttgtccttgcatatttttcctgccagctgtgggaagtgacaggacatggtttaatttgggctgctgttctgtttctttatgcctgcagcagacaggtcttttgaaactcaccctttgcctctcctccctcctataattcatttttttcctcattctttttttcctgacagtgcatattacttgagattttcctggaaaggttgtgattatctggaattggatcttccgccaccttcaacagcttgaatccttgtaggctagcagctaacctagagctggcagactcaaatggaatcttgatctcttcatatttaaggctcagaaaactcaaaaggagtgttctgtaaaatacttctgtttatattatatgtatggtaattagtatgagtataaaatggtcgggcaaaatttagctgggctcagactttcctgtggatcagataaatggaaatgaaaaaaagtatgaggacacagatttgctgattgttcttcatcttttatatttatttcttaacttgtcttggtctactgtagaatgttccagaaatgtcattgggtataatgtctgatttagcactgacttatttgtgggtttgcttggagtgtattttccttgggctttggatatatgactgccataaattttaattacactaattagacgtaggtggatgcttaagcccagttggagtcctagccctgttcagctgcctctgtcattagtttttctggtgacatggtttggcaccatcttccaacacgttttccagacattagttttaagttagaaaataacttgtctaataaagctactgacattcaactagtgtctttaccttgttgaagtggacttgagtaaaatgcatacatttaaactgtaacttgtgtacccgtttctttccttaactgtgggctttcagattcgtttggtggctagagagggagtcatgcccgatcctcatgagtccatgtgctcgtgtctagtttaggtggagcctgacttggcacaaggctgggtggcaggttttaacatgtgtggcaatgctagtcaattggggatatccacatggctcatagtgtagagaaggcttctgaggtctagacccagcaggtgggaagccagccttggttagtgccgtggaccgcgggcacaggaggaggcagtctcaggagcacctctgccctgcatctccctcggaggatatagggccacgtgtgcctgccacttccctgttctcacagctctttgtgatctcagagaagcctctggattttgtttttgggcgagtatgccaactatgtcctccacagcatggggttcaggttgagtttgccattcctagtttctccctagaaacatatccctgatctttaaccctacttaaagggcttaaaacattctactcttacttttaaaggatgctttaaaaatacaggccacatctgtttcacttaatctgcattcaacagcacctcatgacacaaaaagtaatgcagtctgtttgccaagcaagcacttggaaatttcgaggcatggaaactgataggagcctctgtttttccaccttgaggattgttgcgctttgcatccacccagatcatctctcaccagcatccatgctcacagggctgcctctcttcctctcacatatttgcaggcgtgtttgttcactgttcaatgcactcagcttttgtcgagtgcccacttgctctccgcaaggtgttttgaattcatgtatggccaggggctctggtgcaggaaggagcacacagaaccagaagacgcggagcatggggcttcgaaggtctttccttcaggacgccagatgatgagtgcatttctcctttgttattttgctaaagcggctgacagtggttagacacagctgaggaggcgggaggccggcagcacttctgggggtccagcatgctgtttagctactgatgagggtgggcagaagaaacaagcagactccctcctgctctgggacagtttcatgtaggaaaccaggagtctgagccgccgagtatgggcatgttgagggctgctggcctttttgtcagttcttcggaacaggcacgatggggttattttcatctcgaatctcaggctaagggagcttcaggaaaagacttctgcaccattttttaggacattgtttccatatccttttaagtgtaagggtcacttggtgtaatcatttcactacttatttggcaaaaggagtttatagaatcagtgtgagacgtggagaaggtgtgaagacggcgttttcagtccgccgatgtccttttttcctccccgtctctcttgcagagtcgccaacatccagcagcagctggcccggcttgacaatgagtcctggccaagcacggccgaggctgacagggaccggctgcagctcatcaaggagaaggaggccctgctgcaggagcttcagctcatcattgcacagcgccgctctgcgggagatgtggcccggctggaggaggagcgggagcgcctagaggaggagctgcggcgtgcacgggccacctccgcacagggcgccacggagaggtgggtcagcggggacacgacctccagcggaaagcctgctggaaaaactccacggggtggcttgtgtgtggctggagggtgttcctgatgatcactcagagcctctcctgcctggatgttccctggcctaggaggggcatgcggtggggggcactgccttctgctccctgggtctctggagcctctgctccgaagcaggaggtgattgacaagggggaaggagtgagggaagatgggtgacctccatctccgcccacgccccacccttcctgaagttggtgcttggtgcttccacctgcctttgtgggacagtgccctgagcaggctgtggtcccgctccggcccgggcagctctgttgcatgggggaagaattccctgttcctgacgtggtgagcatggtgggtatccacctactgctttcctctccaactttgatttctagccaggagagcctgctcttctctggcattgggaagctggccacctgtcgtgcgtctgtcctgaggctccttcaccacgcaggacatgcaaagccagcatagtggctttggtattcggtggcactgagtcgttcagcctttcctcgtgtgccgtgtgtcctggtttccatttgctgtgtgagactgcagattgtgtcaaaggctgggcctgccttccacacttaacagcagtttctctgtggctatcagctgggcttttggagagcagcccctcccccacgtgttaaagtcttgcccccttgagctcacatgagcagctctacagagactctaatagatgcttggatgattcgatctgttcagatgctcttactcctactgtttcacgatggttgtattgttgggcgtcctttatgcttgatgttcatgggtcatcttcataggagacaagtctgtggcttggcacgaggggctcacggcagcctcagggaagcggtggtgtttggagagttgagctcagagtcctaggcaggtgaatttcattttgcctgagatggtggcatgccctgtcacctcacccggaatcaaccgcgaggagaatctgaatgtgaaagagctcttgcacggctgcgtttgttttcagctaaacatttccttctgttccacccctggtattcttgtatgtgtgttctgcgtaggagggcctgggagttcctgttgcttctctgtgaaggggggaggacttggccccacaaatgtcgcctgcatctcagggccccacacccacgctcctttgactgtggctgctgtcaccatgtggaaatccagcacacacgagtgctgtggcccctgagtacaagtctgcagccctccatggagccagtgttagccccgatgcctgggttcaagggtggggacagcaaagccggaccagctttgactcccatgggggtctctcgtgagaccagcccaggtgctgagtcctgggactcagagccctcgaccaggacctaatcgccccaagcgtgtttcctgaatctgctgctaaatgaccttggccggaaaagcacatccacatgtgctaagcacttgcacgcacatcgcatgggggtggggctcttgtagctctgggctttctgtgccggtacacgcagggcccatttctccactccacctcccttcattggaggggtgtttgcagtttgcaagtatgaggccacatggtaggaggcttcccccagcacaggctggcagcattaggagacccggcgtgggccaggtgcagagagagagtgaggttggtgccttaaggctgagccgtgccagctgtagagctgggcccagtctgcctgtctcacctgcagtgtcatcagcagcaaatgggaggcgtttgccgggctgggggtgtcatccgggggagaaagagagagatgcgcacctccttcaggcctcccgccccggcagatgatacgtgcggcggcctcccagctgctcagagccagcatctctggagggagctggtgcacgtctcctgggctgagggagcaggcttgaggtgaaggacacataccctagataatctctcggatggctcgtgtcaacgcttgcaacatcctttgctattttagcttgctcatgttagtgtgtggcaggcatttatacaagatgctgatgttcaacagagaaccccacggctctattacaagatgcctgccatcctgagaaattctctttccaaggatgactgcttttattataggggtgattataaaatgaaagatctatcaaaaagcaaaaattttgttctgctgaacctgaagtcatgttttcctttgtcataatttaatgacatctttacaataaagtactttatgtaaagtaaataaagacagtaaattagactttatattttcttaatctgttagcttacttttctactccttttcatagcagtggtaaatattctttgaagttcgtttcatttgaattggagacacaaggctatgtgctttaggagttgggccctggccagttttctgccaggaaactgtatccccttttctttttgttgaaaaaataagtacagaagtcaggcaaatgtctaagactcttattttagcagtttatgttccagccagttttttagatgtctcagttattgccagcgtggcccctgtttggtaaggaagttacatttttagtcatctgcaactttcagaataaccagcataaaattagactgcaaatgtgggcagtcatgggcacttgtgtgtgatcttgtatccagatgcgctgtctcttgtgcgctccgaaatgcacctgtttgtataatgacaaatgtgttgtattggatagaaggggggaatttgatctaaaacttttttcactacagataaaacaatctgaaaataagtcatgactaaagacagtctaaaaccgagccgtacatatgaatgtatctatatgtcatatgtgtgaaaacagagctggaatgcgctgacggatttagcgatgggttggaaattctaccctggtcactcaagagtggagccagttttcagtaggaactcaatttagattctattaatttgggatttgagctaatagaattcaggttgggttagaatttctgaaaagcattaagaaaaaagttagtagccttggaccgggcttgggtaaattccctacaacaaatggcttcttggagctggtcactgtttgccactggatacgctctgctggtgtcgtctctgcccctggagtcctctgtgacttaatagtgtcccggtgcttgtgagagtgggttccaagttacagctccaaagctcaatgaaggatgtattttgaactcacttttaaactccctttgaaaactctcggctctccatcttctgaaaaagatggggtttttgaggatatcgcccttgataagcgtcagataggatgtgagtatcacagaaaattggggaaatgtttttcagtagtaaaggaaatgcctgtttgttggtagtgtgccttggctttagggtcaatccagcctgaccgaactttgagcttgcgtagcagacgcaagctactttatatgagtttcttcatctgtaaagcaggaatagaatccaaagaccagtaaggaatgaggcagtgcatagaaagcagtgtgcctttctataagcccctcagtggaactttttttttttgagatggagtctcgctctgtcgcccaggctggagtgcagtggcacgatcttggctcactgcaagctccgactcccgactcccgggttcacgccattctcctgcctcagcctcccgagtagctgggactacaggtgcccgccaccacgcccggctaattttttgtatttttagtagagacggggtttcaccgtgttaaccaggatggtctcgatctcctgacctcgtgatccgcccgcctcggcctcccaaagtgctgggattacaggcgtgagccaccgcgcccggccccagaattgctttttaaacgttactttcatttgtacaagctatcaaaacattttccttaaaaattaaaatatcataggtaagtggaatcttagaacattctactcaagagtttattacagctgttctcaaacattttggtctcagaacctccttccgatgttaaaatgctgaggatcccaaagagcttttgtttgtgttggtttttttaaagttcttttttctaactgttttgttttgtttttcatttttccccacccagggacctatcagtgtttatgtggatttttatctgtcagtatttgctaatttagaagttagcgctgggaaatttttaaaatatttatttattaaagataacaataggccgggcacagtggctcatgcctgtaatcccagcactttgggaggccaaggcaggaggattactttagttcaggagttagagaccagcctaggcaacatgacaaaacctcatctttacaaaaaatacaaaagttagctgggtatggtggcacatgcctgtggtcccagctacttgggagcctgaggtgggaggatggcttgagcccgggaggtggaggtggcagtgagctctgatcgcaccactgcactccagcctgcacaacagagcaaggccccatctcaataaataaaaaaagacaatacaaaccctattatgtgttaatattagtaacatttttatgactgataacttttttgaaacaaaaaactatagtgagaagagtggtattatttgcccttgctatccatctctttagcgtctggcttgctagaaggcagctgctttggccattggtgcattcggcctgttgagatagggtcattttgagtgaacacgtgaagaccatctagctgcttaccgatatgccattgggaaggaggggacctcataggacccctgaaggagttttggggatccgccaggggtctttggatcatgctttggaaaccattggtttcaatatatgatattgaacttgaaagtgggttgtgtcgtggctccatttaggacgatgcttgttactctcttgccagctgacctctgcatggcaccatttggaattttgtttgcatcaagagaaacaaaggctcatcagaatttatggcatgtggttgaaacttgtaaacaaactcagactggtttgtcttccttatcctaagttggtggcgcatctgtttcctttatgggtgatagcagctctttgtcaatcacgtgtcatctgccgtacattattttatctatgcagcatcagttccctgagctggagattgtggactccatttttacaggtaatgaaactaagggctcagagagggtgagacatttgcctaaggccacacagcttgtgagtgactggccaggtgggattctctgaatcccaggctgctgtcagacactgtgtctggtttcctctcactcccacctagccaagctctttaaaccccttcggcatgtccccttccctgttggtggaaagaggaaggtattaaaggggcctactgtggccacacgtcacagtgtcatttccatttgtaaaccaggagtgtttccttctagaggcaaacatatttattcatggagttgtccaacaactgtgtattgagtgcctatccacaataggctcgattctaggcggtgggcctactgcagtaggaataaattttattctacaaaattactaagtagaaaaaagtagaaggaaggaaaacaaaaatacctccaaccccatggcctggagatggcaacggctgctgttttgtttcatttgcttctaatgttttaactgtatagatcttagaattatatttgttcttctctagaaggtggcctagtatgagggaatctgatttgttccaaggaatttcaacagatgactgcgtgctctgcgtttgagctcatctgctagttatctgtccttctgctcacttaccactcctcccatccatccaagcagccatccccagccacccacccagccagccatctagccacccacccagccacccacccagccacccatccagccacccatccagccacctacccagccagccatccaccaacccagccacccatccagccacccacccagccacccagccacccatccagccacccacccacccatccagccacccacccatccagccacccacccacacattgacccatccctgtgcccactcctcttctcacgcatcccctcccccgtgcactgtgcctggcgcttccacagagtagcaggcactgctcagggtgccagggatgtatttttcaaacgggacaaaagcagtctctgtgatcttggcccttgtgacctgggtgcttttagaatgggtggtgattgcaacctaattcagctggagggaattgatagtggactgtcttgttatgaaaatattctccctgtctttgaaatgtactaatcgactgtcttcttacctacaggattctgcttcaggaaaaaaggaattgtctacttatgcagctggaagaagccacccgcttaacatcctacctccagtcccagttaaaaaggtaggttactttcaaagagaaaactgtacttgttcatcatgttccaatgactggtacatgaactcgtttcttgtagcttgacctgaaatgttgttaacacagaatggatacattatatttttaacatgctactactgtatgactcaaggaatatggagagaaccacatttggcttcagggtaaataagaggcctgaagtcagatgtattcaaggattttgtaacctaattaacagtttcagaagtgtacatctatacacgtgcgcatttttgttttgggttttttttaaaagcatacgaactttttaagctagtaagatttggctgctcaagaatggccaatgtcaagggcctcagatgtgtcattttctcagatattcctcctaacaatgccccaggtgggaactgttctcaccccagccccagtgggagcccagagggggtgaatggcttgaccaagtgtacctggctagtatgtgttccagccaggactgggactgggacttgggcacgggtctctgctgttgcccactgctctctgccaccctttccgtgctcacagggtgagcaggggtggctgccctgccatctcagatggccatgctgtctcatttcagcctgtgtgccagcaccctgacggtgtcctcggggagcagccgcgggtccctagcctccagccgtgggtctctggcctccagccggggctccctgagctcggtcagcttcacggacatctacggcctcccgcagtacgagaagcccgacgctgagggcagccagcttctacgcttcgacctcattcccttcgactctctggggcgagatgctcccttttcagagcccccaggcccctcgggcttccacaagcagaggcggtccctggacacgccccagtccctggcatcgctgtcctcccgctcctcgctgtcctcgctgtcgcccccaagctcgcccctggacacgcccttcctccctgcctcacgggactcgccgctggcgcagctggcggacagctgtgaggggccaggcctgggcgccctagacagactgcgggcacacgcctcggctatgggggacgaagacttaccaggcatggcggcccttcagccacacggggtccccggggatggggaagggccgcacgagcgaggacccccaccagccagcgctcccgtgggtggaagtaagtgcggatgtggcctcctgcggggcgagggttacctgcagggcggaaactgtggggtccagagtgaggatggctggctttccaggtccatggtgagctttacgtttaggaatattgatgtgatcgggaagagcacacacctgctctttctgatctgtgttggggaaagatcattgaaattgacaaagttgtctttcctaggtatttggcttgttttcaaaaaatacttaattgttgaaaactagggtaagaactacacaggcttccacattcagaggctgctggagatggattagggccttcatgacctttgcagcgtgcgtgccgagatggaaccgtcagtgtgtgcccgcctgagaccattatgccaacaggtgtctggttgtagctagtggaaatcttgacttcttttgttgctttgacatctctttatcttttatagttttcatagtttccaagaacataggtctatcaaatgtggaagtgaaaataattgtgtaatttcaaaagacatgcctgtaagtatcggtcatttctactgatttggtttctctggtgattcttcaaatggaaaaacacggagctccgtggagcctcatccattcagttggtgttggttcagctcctcctcggagctggggtctttcagcttgtagcctgcttggaagaccaaactgctattgaagggaatattgaccccatgtgcttttctcagccacccatggcaactttatcttcctttggttttaaagaggatcaagaacaaggtctcccgttcctgaagttcagcccatttaattgacttttatttgcacggcaaaaatgttttaaatgttccatttaggcaaacactagataatttgtgcagcatagtggatctcagccaggggtgtttttgcgtcctgcccctggggaacacttggcaatgtctggaaacatttttggttgtcacaactaggggatgggagatgctcctggcatgcacagggcagcaccccctccccctcgagaatggtccagccccaaatgtcaagagggctgaggctgagaaaccctagtcacgtactatggagtatttatgcggcaaggggtagaaataaaactagagagcagaaccagtgtggtgtagtggaaacagcttcaaactagcagctgggagaccaggcttttgttccctgccctgtccacttctagctgtgtgaccttgaacacatacctggactgagtctcaccttttccacccttgaatgcagtgatctttgtgaccccttccatttgccaccattctgttacccaagagatagatggattggtagatcaatagataggttgatcactctataaaatagtagtctgttggcacttacgtgcgtaaccagaggccatcatgttctgagactgccccagggctttttggcatctctattttggtgtctgcccctgtgtttgcaaacacactttggtatccccagatacattgtttctgaagtccatatatgcaggtatccttcattagctttgttcctctttataaccacaggttgattgctccatgtttattccgttcagtcagaaaagaaatatccaattaggacttctttcttagtctccctcctctctcccaccaccttctccttaagggattgagattccagaatgtcagtctagttaggcataaaatctgcacaaggcccaagggccactttgggtcagaggagagacagagtgggagggagaagcgctgacttaatttcacatcctggtttctttattttttcctttgctttccgtggcagatgctataatggttgaaacttcttggactgggaagtatttgcttacgtgtgtagacactgccatctcgtggtggagccatatgtcattcgtgattatttcttgtattacactgccatcttgtggcggattcgtatatgacattggtgatgaattcttgtatggcactgccatctggtggcggattcttatatgacaccgccaataaattcctgagtgacactgccatctggtggtagattcttatatgacatcggtggtggattcttgcgtgacactgccgcctagcggtagctttttatgatactgccatctggtgatggttttatatgttacatatattacattgtttcaaggacacatatgtattatgttgttctaaggacacgtttatttgtatccttagaaacttgaaatagttgaccctgctgggtgtccccagagggccgggttgggtagccagcttcaggcatggacacagggggggctcctcgcctcccctgccccatcatgtatcagctgtgctgggaacactgcagtctaagtttggcccccagcaagtcttagtaagacaaaatttttgtaagataaaaatcaaagttgtccaaacttgcaaaccagcctctgaatgattttttccttgtgttttcaatcaatcggaggaaacagaaggcaggtcagaggagtggggcaatacactgtgatttttcatactatttacgtttttgttacagttttgtcttccctggattttaaaagtcaaatgtgttatgattatgaaatacttagctattttcatctacccattagtatttgctaatcaaaacctgtaaaaatcttgactttgctcatattgatgtttttatgatattgatattctgtttaatgttgttggcttaaattctgcagtgttttcactttgtgcttttttttttttttatctcctcatgcggctcgacagaagtgctcactgtaagtggccttgggagtccccttgctcagcgttgttgctcaggccccaggcatacgtttgtgctgtggatggatgtgttcaggatggctggggtgtggccaacgacggttatcttatagctgtgcttcaacacaagttggcaattggccttattgttatctcattgttaatattcaagctgtttaagaactttcctagaagctttcactgttcattccctgtatgtgtttgtttctggaatgtaatggcgttcgttgctgtcatatgccacctggcagctctgctatgctgtggttttgactgtattttcttcctttttaccaagcactgttcacatccttggctcttagtgtctgtctgtcttgaatgatgaaaagggagtaaagagattttcacatgaacatggggaagatttgacccttgtctccctggcactgctcctgagggtccacctctgtgccttgaagccccagggcaggtgtccggggtgtggagcgtggagtctgtgctttttctcagccggggcagttgccgacaggacttcctcctggcagttcctacttccacccaccctgtgggtccagtgactcagcctgggcttcgaggattagctccttcatttctttcctctctgtattgacttctatggcaatgatgagagagaaacgtggccagacttgcgccttgggctgggttggttgcaggtgcttaggctcattacctggtgctgtttccctgcaggcatctacagctgagtctggggaccacgcgtgtcaaggctgggaatgcaaatggtagtggtggtttcctttgctgggggttgatgcagtggttgggggggcttccatttgcagttgagggccaggtgtttgggtccttccatgtggcagggataaagaggagagctggcatctggagtcatgatctgtctgagaggcagtgcctccggccaccgtaggatggaggccagcttccagccctggctgatgggggagaagcagcgaattctccagatgtggtatggcagacctttggaagattcactcggcctccacttaaccttgtgagaccaaaggccacagccccatgtgttctgcgtgctgttgaacatgtttgtatttcattggcgtggatgataatttggttgaaaggagagatggtcaccagtggactcagtttaggaaggcacaaaggtcaaccctttccgtttctagaacttagccaaagaaaagtgcggagatggaagcgggagctggctttgagtgacggtggagtgcccagctggggcttccaatttgattccgtgttccagccgagtgtgcccctccacaaaacagactcctgggctcacagttgcatttagcgcgggaagatgatatacatgtttgtattggttttgttaaaaggaacttattgctatgaggaaatgggtagaaacggctgatgaaatgttaaaaggaaacatttcaatggctatttttggctcttgaataaaatagatgtgaaagataaaaataagcatagcaggaatagcagcgtgctaacccagaagggcggctggaaggctcctgcctgcggtcactgagacagccacgcttgagccccagcttcctcccccggggccgcaggcctcccaggtggtgttttcagagaatgagtgtgggttcaactgtgtcctctgctttgaaggttgctaatttttctagggtttatttggataattaaaatgtttttttcctgagtataaaagcagtatttgttgtataaaacatgggaaatacccgacagcataaagaaggcagtgaaaaccatgacctcttggcgagcgccgctgctgttcccatcgggctaatgctgctttcctgtctcgtttgtgtgcgcggctttcagaaagtgccatttgaggggcttctcatcgtcatcttatgttctgtgtgttcattaagggggtggaaatagatttatgaatccaagaggtagcagaagttcatttcttcaattttcccatatgaaaaacaactagagcacagcatgtctccgtgtgtgtgtgtcccagcgagtctctggaacactcattgacgaagtgtgtgctccagcgtcaaggaccccggtccccggtgctgttatttcctgaccctgtgtgtgtcccttacttacagcagtgactcttcgagaagacagtgccaagaggttggagaggagggcacgccgcatctccgcatgtctgtcggattattcgctagccagcgacagtggggtgtttgaacctctaaccaaaaggtctgaagctagtcttactatttccttctccctacgcagaatcacctgtgttactggcaatcacaaaaagattccgtactgaaactttcatacattgacactttgtttatttttccaggggtaggatatttttctagcttctttcacctttgggtgattgggttttagaaagaagtctttctccctggccctgggggcctaaggcttgagtctgatggagctcaaaaaggagaatcaatgtatgggagagccctgcttttctggaaaggacattcattcattagaaatgaatttcttccctccctcccttccttgttttcgtagctataggaatggtttcacaatgacacagcgccttttggaattccatgctttattttgatcgggcatctttgatgtcattatttctttgtacaatttaagtctccggtatctagaagacagttcacttaaagttaatttttgaacatttcctcaagtattacatgtggttttgaaaggcgtgcaaggttactttcttcttttatttatttattttttgtttgtttgtttgagacaggctctcgctgtcgcccaggctggagtgcagtggtgcaatcatagctcactgcagcctcaaactcctgggcttaagcagttctcccacctcagccccacagatatctgggattatagcacacaccaccgtgcctggctaatttttgtatttttagtagagatggggtttcatcatgttgcccaggctggtcttgaactcctgggcttaagcgatcggcccgcctctgcctcccaaagtgttgggattatagatctactccaccatacttggctaattttgtttgtatttttaatagagatggggtttcaccatgttggccagactggtctcaaactcctggcttcaagtgatccacccacctcagcctcccaaagtgctgggattacaggcatgagccatcgtgcccagccacaaagtctattttcctaaaacaggaacaacataagaaataggctgggcgcggcggctcacgcctgtaatcccagcactttgggaggctgaggtgggctgatcacctgaggtcaggagtttgagaccagcctggccaacatggtgaaaccctgtctctactaaaagtacaaacattagctgggcgttgtggtgggtgcctgtaatcccagctactggggaagctgaggcaggagaatcgcttgagcccaggaggtggaggttgcagtgagccgaggttgcaccagtgcactccagcctgggcaacagagccagactctatctcagaaacaaaacaaaataaaacaacaaaaatacccagcagtttgtaggcaggtacccagtaagatgcctcatggattctgggggcccgccctgttccttcagacacatgatgacctcattgacttaacgtcacaacttaacaaagccctctctcagcacgagggagctcctgcagaatctgtagcgaccggttccctcaggaatgaagttggttgcatttacccctctgttcaggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggctggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgctctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccagggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccagcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaaagaacacaaactcccaccctcgagagggaggcgccaaaggagacgttgctatcatacgttcatgtcacagagagcaaggcggcttctggagaatgcaatggcagggaagcgggcaaacacttgtagagaggtttgcagttttagaaagggttcacatttagaaatgtaaatttatatttacattttacaaacatcaggatgataaaagggtgcaactgctacggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggcagtcacaggcaaaatcctaaaccaatccatggaggttacacgttgcttttggcctagaaggataggatatcttaatgtgggggcttacaggacgtagatggattcaaagattttctgattgcagttggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgaccgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccgttggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcttttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtacaggccctcccacccgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaagaatccattctgagactctgactacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccgtctcaaaaaaaaaaaaaaaaagtgcataatttggcttcagaagtgtctctcagcagcaccactgctggcatttcagacaggctcattctttgctgtgggggctgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtctcagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcatggtttataacgtactttctttccccttgtacagtggatcattaagatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacagaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactccagccaccccctggcctctgtctcctgggaggaattccttggggggagtgtgggtgaggtgggccttactccctcctgtcaccactcgctgactgtggttggttcttctgggctccagggttggcagtgaacttactcattcttccttaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccctgggaagttgagaacaaaacaggaatccactgcagccagtagtgtattttcatgtttttatcctgatctttttttcctacagtttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatgcccattaagcagtcactccccgttctccctcccctagctctgtctctagggatatgcctttctgcctgtttcataggaatgggatcatatcttacgtggacttttgcatctggcttctttcctgcagctgagggttttcgaggttcatccatgtagcctatgtgccagtgtgtccttccttgttaagggcgaataaaatgtgtcttttagccctaatttttgtatacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgcccgcctccccccaccccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaatcactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacagagtggaaatgtgtggctttatggaaaaagaatgtttaattatggaagcttaaatatataaaaatgtgtgtttttcaagcataaaaacagaggtataaaatcagagaaaatagctgaacgcagcgctcacccagcttcaacacgatcattcacggctgccctctcctttaccctccagcccacctcctcctcttagaatttgaagcaaagcccatatagcttatcatttcatctttaaatatttcaatatgtattgctaaaagagaaaaacataataaccttatcacatcttagcatttaataattccttactgttaccaaatagccaaggttttctctcccatttatcttgtgtcattctttaactctttgaacagaatctaaacatgattcacttattgggattttttttgtctgtgtttttcttttttggtaatagcttttcttgatacataattcacatgctatacaattcacccatttaatatgtataattcagtggttttagtatattcagagtcgtgcaaatatcacaatttttagaacgttttcatcaccccccaaaaaagccttcagactcattagcagttgctccccaatcctctgagaccccagctaccactgacctctctgtctctacacatttgcccgttctgaacatttcatatcaatgacataacatgtggcctttgtgtctgggttcattcacttagcataatgctttcaagattcatccgtgttgtagtgtgtgttgagacttcattcttttttatggctgaatcatcttccattgcatggacaggccacattttcttcatttatcagttgatggacactttgcttccactttttggccattatggataatgctgctatggacttttacatttaagcttttctgtggatatatgttttcatttctcttaggtcaatacctaaaagtggaatcactgggttacatggtaactccatatttaactctttgaggacttgccagactgtttccaaagcagctgtgccatttcccattcctaccggcagttgctccacatcctggccaacacttgttatgtccttttgcttatagctatcttaggggatgccaagtggtatctcattgtagttatgtctggcttttttttgagatggagtcttgctctgttgtctagcctgcagtgcagtggcgcggtctcaactcactgcagcctccgcctcccgggttcaagtgattctcctgcctcagcctctggagtagatgggattacaggtgtgtgccaccatgctcagctaatttttgtgtttttggtagagacagagttttaccatgttggccaggctggtctcaaactcctgacctcaagtgatctgcctgccttggcctcccaaagtgctgggattacaggcgtgagccaccacgccccacagagtcagatttttattcttgcctctaccctattttttcccctctccttacaggtaaccattgaaaagagattactgtttttccttgcattgttattttaaaatataagcaggtatataaatatgtaagtgtgtacatacaaatatatacatgtgtgcatttacacatatacacatgactacacaaatatgaacacatctatatttgtatttttctctccttgggcaaatggtagcataaaaacatacttttcttcacctggcttttttcacttaaaagtatatcccagccaatggtggtggtgcacacctgtagtcccagctacttgggaggctgaggtgggaggatcctttgacaccagcagttcaagagtagcctggacgatgtagtgagactgcatttctttaaaaaaagaaaaatagatatatcccagagaccaccaaagtctgtattggctgctataacaatttaccacaagcttggtagcttaacaaaaatttatttcacggttctcaaggccaaaagtgctaaatcaaagtgtcaccagggctacactctcttcaaaggccctaggggaggatccttcccgcctcttccggctcttgctgctgctgacaatccttggcttgtgcaagaaacatgactccagtcttggccccatcgtgacatcaccgttctctctgcgtttctccctgtcttctctctattacaagaacatctgccattggatttagggcctacccggttaatccaggatgatcgcatctccaggtctttaattacctccgcaaagactctttgcaaataaggtcacgttcccaagttccaggtagacatatctttaggcccaccattcaatccactatgatctgtcctctgcatcccccccctccaaattcacatccaacccacaagcaaaatacattcaccccatccccatatcccccaaaggtatgtgtaagtgttcttttcattttacctttgcacacaacattagtggatgtaccattgtttattcaaccatcttctggttgtttctagtcatactattaaaaataattgaacaggccgggcgcggtggctcatgcctgtaatcccagcactttgggaggcccaggtgggcagatcatgagatcaggagtttgagaccagcctgaccaacatggtaaaaccccatctctactaaaaatacaaaaattagctgggcatggtggcgtgcacctgtaatcccagctactcaggaggctgaggcaggagaatcggttgaacctggggggcagaggtggcagtgagccgagatcgtgccattgcactccagcctgggcgacagagcgagactccgtctcaaaaaataataattcaacaatgaaagtcttctgcagacatcttttcacatttttgccagggtttctttttttattttattgatagaaacggtattgccgtgttgcccatgctggtctccaactcctggtctcaagctatcctcctgcctcgatctcccaaagtgttgggatttcaggtgtgagccaccctgcccggcctttgccagggttttcgtgagatacatcccaagaagtgggatctctgggtcaacagtaatgcatgcggcatgttgctgggtgttgctgcatttttctcacggggactttgccattttgtattctcaccagcaatgtatgagacagttccctcacaacctcagcaatagaatggtgtcacatttgtgagtctttgccagttgcagaggtgagaaagcatctcagcacaatcaaaatttgtgcttatgagcaaagctgctttaattatagaggcttgttggtaagttttaatatcagttagggctagccctccttcctttcttctttctcagggcttccctggatattcttgcttatttgttctttcaaatgaattttataattatcttgtctagctccagggaaaaaaaattatgaatctactggaattgcattaaacgtacaaatttgggagaaccgcaatctttatgatgttgaatcctcttatccaagagtgtatttccatttgtccaagactaattttgtgcctttcaggaatgctttatagttttactcgtatgtattttggatatttcttcatgagtttttgtctattttgttttctgtctttgtctgcataaagacagaaaataacaataagataaatacacatacatgcaaggctatttaccttttttcagactttggtggaaaaactagtgtttccccattaaataagatgttgaggccgagtgtggtgtctcatgcctgtatcccagcattttgagaagctgaggtgggaggaccgcttgagcccaggagttcaagaccagcatgggcaacatagcgagaccccgtttctacaaaaaaaatacaaaaagttagctgggcatggtggcatgtgcctgtggtcccagctacacaggaggctgagcttgagccccagaggtcaaggctgcagtgagccgtgttcatgccattgcactccagcctgggtgacagagtgagaccctgtcttgaagaaaaaaagtggccggggcggtggctcacgcctgtaatcccagcactttgggaggccgaggtgggcagatcacgaggtcaggagttcgagaccagcctggccaacacagtgaaaccccatctctactaaaaatacaaaaattagctgggcatggtggcatacgcctgcagtcccagctactcgggaggctgaggcagaagaatcacttgaacccggtaggcggaggttgcagtgagccgagactgcaccactgtactccagcctgggtgacacagtgagaatctgtctcaaaaaacaaaaatgaaaagcacaggttgtggcttgtggttctgaccgactggctatacaatgggggttcccatgaccccctcctcaagttcactgacatgctagagtggtcccacaactcagggaaacatgtttagccatttgttataaaggatattaccaaagatacagatgtacagcctgatggaagcgatgtggaaggtatggaaggcaaggcacggagcttccatgcccttccctaggcaccaccctccaggaacctctgtgtattcagctatctggaagcccacggaaaaccctgtccttttgtgggcttttgtttgtttgtttgttactgaagttttgtttttattatactttaagttctagggtacatgtgcacaatgtgcaggtttgttacatatgtatacatgtgccatgttggtgtgctgcacccgttaactcgtcatttacattaggtatatctcctaatgctatctctcccccctcccccgaccccacaacagtccccggagtgtgatgttccccaccctgtgtccatgtgttctcattgttaaattcccacctatgagtgagaacatgtggtgtttggtttttatggaggttccattgcataggcatgattgattacatcattgaccactggtgataaactcaagcttcagcccctctcccctccccggaggtcaaggaggtggggttaaaagtccccaatctgttatcttgccttggtctttctggtgactggtgaccagcccctatcctgaggctacctagggccctcagctaccatcatctctttcgcatacaaaagacactcattactctggatgtctcaaaacaaacaaacaaaaaaccttttagcctgggaatggtggctaacacctgtaatcccagcagtttgggaggccaaggcaggtggatcacctgagatcgggagtttgagaccagcctgaccaacatggtgaaaccctgtctccattaaaatacaaaaatgtagccgggcgtggtggtgggcgcctgtaatcccagccacctgggaggctgaggcaggagaatcacttgaaccctggagatggaggttgcagtgagctgaaatcatgccactgcactgcagcttgggcaacagagtgaaactctgtctcaaaaacaaacaaacaaacaaaaggcaaaaataactttgagcaatgctactgtggccaaattttacttgttgcagttgctgtagcagaaagaaggcctttccctcctggctacctatgggcactccctgtcttctctctggtccactcttccacagtccccaacttgagctaactcccacttgtccttggatagcttaaccatgactttctcaaggaggccggaagtggtctccatccctgaagaaatttggcccctctgctttatgtacgtgtatgagttcgctaggcctgccgtaaccaagtcccacagactgggtggcttcgacaacagacattgattttctcactggaggctggaagttcaagatgaaggcactggcaggctggtttcccgaggcctctcccctcagcttgctgcctcctcacgtggtcatcactctgcatgcatgaccctggggtctccttttttttttttcatagggacaccagtcagatgggactagggccccaccctagcggcctgatgtgaaaacataaccacttctttaaagaacttatctccaaatatagtcacattctgaggtactggggagttgagacttcaacatatgaatttgggagtacataattcaacccctagcggtatttttccacatcactcaacacttctctcatcagggattccccactcttgattgggaagacctgtttcatgactgtcttccccatggactgtaagagggactcagcagagggacacagtcactcccgagcgtggctgaccctcgggccttgcattctgcctggtgcagacggagggctccgtaaataggaatcggatgaatcaatgagccaaggctctgttcgtttccaatggctgctgtacttagcggcttaaaacaacacatattcatccttttccttttctggagggtagaagtctaaactgggtgtgaatgggctaaaatcaagtgccagcagggctgtgttccttccataggctagtggagagattctgtttcctggcctcttccagcttctagaggccacttgcatttgttcgcttatggccctatcctccatcttcaaggccagcagtgtagcagcttcaaatctccctctctgatctctgcttccattgccaatcttctctgactctgaccctcctgcctcccttttataatgatccttgtgacgacactgggcccactggggccacccaggatcatctccccacgatcttaggatccctaatctaatcacatctgcaaaatctcttttgtcacgtaaagcaacatcttcacaggtcctgggaataagggggtgaacatctttggggaggtcattctccagcccaccctagaagcactgagctttgaagggccggttcctgtattcagtatgtatgtactccggcatgcatctcaagttttgctttggaacaagtgatcagacgctcccctcttagaagattcccaggctcctggtgaagtccaacggcagaggctgcacattcagtggcatttggaagcatcttgtctgagacctgtggctagaggcacacggccttctggaatctgtgcctttccattgttcccactaacagacgctctggccagattgctgtttctaccctgcaattacaggcagaatcccatgagtaataaacacaaattgttttattgcaatggagttcgtttaaaagaaatattttactgcatcatccaatagaattatctgcaatgatggaattgttttatatctgcgctaaaataccgtagtgacaagccacatgtagctcttgagcatctgacatgtggctagtgtgactgagggactgaattggaacttttaagttaaattcattttcatgtaaatagtaactgtgtctagtggctaccatagagcagtgcaattctagaaaaatcccatttccaacccaaggcacctggacaaggagcagcttttctcagaggccaggtcctgggtgagaaaagctgttcactgtccaggtgcaataagataactgacttctgtctgtgcgtggtggagatgctgtccaatgatggctatcgtgcatcagtttccagctccccattcagtagttcgaagcaaggcatggcaggagaatttacaccaggagaatcagcacaagctacaaatcaagcctccctccccatgccccacccttggagagctgggttatttaacgatgactgacatgccactgtgcatatgcctactggaggagacaggcctactgaattgccttggcaacatctgagtctcctggcactcacagagaaaaaggagacagtggcagctccacagttcttattgtcagagaggaaaagcaccatatggtttttttaagggatggcaacacttctcttaggccttagagctacacgggctcttttctcaggcttcccagcacagacaatgtccttgacaacaactccactccactgcaaaagcagagggatttcaaagctgttgtttgtcacgtcagtcaaggctgtcactttggatcgatgtcagggcaatggggtctgagtttgcagcttttggatgtctgctgagatctgtgaacacagcccagaatgcctagaaaaggctggattgcatattcttatatcccatgtcacttacttattccccaaatcttttaggatgctggccatgtgcatagcccccagctaggtatggaagcaactcattcattcattcattcattcattggagatggtgtattcaggtgtaaaggagttcaggatacaaagatagatgaaatagggtcttcacctccaggttttataagatcccccatttatagaataatttaccagatactcagggctggaatttggaggaggtgagggaggcacttaccttgggtgcaaaacgtaagagggcaccacaaaaatcagtaatcaagataatatactggccaggcacggtgactcacgcctgtaatcccaccactttgggaggctgaggtgggtggatcacctgaggtcgggagtttgagaccagcctggccaacatggcaaaaccccgtctctactaaaaatacaaaaattagccaggtgtggtggtaggcacctgtaatcccagctactcaggaggctgaggcaggagaattgtttgaacctgggagatggaggttgcagtgaggcaagatcatgccactgcactccagcctgggcgacgagagcaaaaccccatctcaaaaaaaaaaaaaaaaatatatatatatgtatatacacacacacatatatatgtatatatatacacacacacatatatatgtacatatatatgtacatatataatttataaaatcaaaattagtgcagaaaattacaatgtacaagatatgaacattttaaataaggacaggctgttgtggtttgtttcactccccttcagtgttgggcaagggagcatagtcaattccaatcagcgaggggttacttggccaggaggtatctgaaggggaggtttatgtgggtgcaaataaattgggccacggggagcattatacatagtttctgtgcgtgtgtgtttcggttgtagggtctttactgacttttttcacttggttcaaaatacaagagggtatcttgatcactgtatttaggggtacacaacttttcttgtgtctcaaattctaataataaggcactgcttgtgctctttccagatctctcacttacgtctcactcagctacaagtggtggatactattactcttcctccttctccttgttttacagaagggaaaagtggggcttgcagaagcttggcaaaatagcacaggcagtaatactgcaatacagccatgtaatacttcaagatggtgtatgattaaagcggttggctgagaacatttgggaaaattttagttctggtgtaacaaactgtatcccagagacagtgctatatgctgggctttcaaagagcaggtaaatgcagctcccctctgtccttccaggagctcaggagctcaggagctcaggggttaatgcgagtaaataatttgggtctaagctggtgagtgctgtccagagggtcccaggaagctgtggctccaagaagggtggaggggatggtcagaggcgcctggggaagaagctggggtcctggccagagaagacctagcctgaccccagggtgctccagcctccatcagaacaggaggctgatgtcagggctgtctctgagcctgtctgcaaaatgggtgcacagcagatctgccctactcctgttaaccagctgctgcgagaatcagatgacatgctgcagaggaaggcactctctacagggtgcatgtgctgaggcgggcggatcagttgagatcaggagttcgagaccatcctgggcaacatagtgaaaccccatctctactaaaaatacaaaaattagccaggtgtggtggtgggcgcctgtaatcccacctactcaggagactgaggcacaagaaacgcttgaacccgggaggcggaggttgtagtgagttgagattgcaccactgtagcctgggcgacaaagcaagactgtctaaaaaaaaaaatatatatatatatatatatataaaatatatatgtataatatataatatatatacaaacacacacacatatatatgggggcttggacacaaagaggcaatagggtcctcacctctaggttttgtaaaacccaccatttatagaataattgaatagtgagttttaacaatttagtggtgggaaaatgtctgttttaaaaatatacagtgcatccaaatctatgaaaatttcccatccacctctgtgccaagccacacagttttcctccctagagataacacccttagcagttcccgatgtctcttttcagaggtggtttgtggtgcacacacaggtgggcaatgacacgtcccacatgctgggagtactacctttaagggatttataatgaagagagcttccagcacatcatacaatggggaactcttgaaaatggctgggaaatggaacatcttgggcatcaaattatactccatcagtaattcaaaccagggtttctcgacttcagcactattgtactgatattttgggccgaaatgttcattgtcccgggaggtaggagtggagagggagctgtcctgtgcactgtaggatgttcagcagcagccctggcctctacccactcaatgccaggagcacacggctcctcccacttcagttgtggctgccaaaaatgtcccctgggggaaagggagcaacatcaccccattaagaaccgctgttctaaaccttgtatgacatctgtagaaaactggcagataagagaaaaaatgtagaagattcaaagggataggaaagagaaatctgtgaagacaatggaaagagcctgtagtcccagttacttgggaggctgaggcaggaggattgcttgagcccaggaatttgaggttgcagtgagccatgatcgtgccactgcactccagcctgggagacagggtgagaccctgtctcgaatgaacaaaaaactcaaaggttattattccgtaactattgaaagaatcttttcatgaaggatggtaataaccagctttctatctccacacagagcaaagtaaaaagaagtaggtttaaatggaagagaaattaaaactggacatacagatggttaaatattaacaacggcccctgaatggcactttctttcctaaagatcttcatgagcagaataatctaggatggctagggattgttccctcgggactttgtggttaagaattcaggatcttcaagtaatgaaatctgcattaaaaaattagccaaaactgtttgtttattccataatcatgtctatatggtgcttttaagaaaacaatttttttgttgctataaaagcaatacatattcactgtggaaaaattagacgatatctctaagcttaaaagaagaaaaatttaaaacacccttaatcccactaaccagtgagataccatgtttgatactttagtgaattcatttcctaatagttttctgtgttcgcaaaggtatatgtgtagatataaatatattacacctacatagaaacgacggatcactcagcacataatgctttgaagcttccattttttttcccatttaatccgctgcacatgtctttttccatccgtgtgtaccaccgtattagttttaattcttccactgcacagatggcttataatttaaaacatcccctgtttttggagatttaacttgtttccagtgctttgagatcataagtaatattgcagcaaactttccctagtcaggggtttgcacaccgttcttccccccacccccactccccacaccccaggacaaattcttggacatcaagttgctggagcacatgataccaacagctgtagggcccggagtaattggcgaaactgtgtatctgtaaggcatttggtaggaaaaatgctaaacagaccaccagaaagattgctcaacttacattcccatgggtggtattggtttttgctttttttggttttgttttttaatcttggctaaaatgacaatttgaaaggcgagggtggagggtgttcagacagctctctcattctgttgagaattgcttggcccagttctgggccttgtctgaattgccggtttgctgcaatgttttttacaattgagcaatcacctagaaaaaagagaaggtgaaactaacctactgcaaaaaaactgctccaggatgaagaaggttgcctgtatttcgtcatttcagccaagccggaatacggagcaaggctgtctgcaccgtgctaccatcctcttcaggctgcagggcattttgtatacccaccacctcccattgatgctggaaaatccggtcacagaattccgtgcagcccagcccctgagggtggggcgtcctgtctccgggacgccgggttttctctggacacgaatgctccgggggtaggaggcgaatgacactggcacggcggggctccggagccaagaggtgaccaggctggctgggcagggctgagtggctgggccgagcacgtgatgctcccagccggcctccggggccctccgggctgaaatcgacatttgcctctggcaggaaaatgagcttgtcagtttctgcctccattagaccctcaacccaaaggagcaggagatttcggtagcgttttaactttatctcagaatctgaaagcggaaggtaagctgcttatcactcagaaaaacaaatttgagaggagtgacctagtaaagtacactgcgactttgttgatttttaaaatctggtgttgaaaataattgatcgctgtgagagtcaagggctgtatttatccccaaattagagattaaccttctgaacagaaatttggttaatttggagggaatcacggtataagggccagggttaaatatagaaggacacgaaagctgatggaataaactgcaagtaaacttaactctagcctgcttgtaaaacaatctatttcatgtctccttcagggctgtgagcaaagggaatgttaaaattgtgatttttaactcaagtgaaagtaaatgaatctatttgcaattggaatacaaataaaagcagtctttgcttttgtccttttacatttcaaaaacgcttgtgtattttggcaaaagaaaagtttatatgtgcactgcttaagtttgaaatacgctatttcaaatttacaaaattatcacagttgtaattttctaaagtctttctaggcaaggctgtttcagttgtgaatgagaaatgttgacattgtacatattttctgtgatagtaaaatgactcacttcttcagaatgtgataaagattagaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcagctattcagagtaattaaagcattattcatccgtgcaattagtataatgttccataatgaattgctttgaactaaagtgtttggtataatactcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcattattttgcaaggttccagcatttacagggcatacgtcagaaacgtattttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacatggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggacggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcggcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtcttttttttttttttttttttttgagacagagtctcggtctgtcacccaggctgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtgtaattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcggtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctatttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgcccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaaaggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctataggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgataagaaaccgtcagcttgtggtgcttttagcctctgttatgggtccagagtccactccctcaggctccattgattctgtgtcgaatgcctgtggctggatatcaggaggacacctgtttttgtcagcccaactcttttcatgagtgaaaagtaacaagggaaacaagatgaattcagaaaaacaaacaaacaaacaaacaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataagcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgatggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaagccccctctgagactaggggctcccagcaccaaggaactggcagccagcagccagcagccactgaggccagcacctctcgtaatccacaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctatgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctccctctctctctctctctctctctctctgtgtgtgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattttgggaggctgaggtaggaggattgtttgagcccaggagtttgagaccagcctgggcaacatagtgagaccccatctctacagataataaaaaaaaattagccagtgtggtggcatgcatctgtggtcccatcttctcaagaggctgaggcaggaggatcgcttgagtctgggaggttgaggctgtgttgagctgtgattgtgccactgcactctactgtgggtgacagagtgagaccctgaaaaaaaaaagaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagactgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtagaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcattgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcgtcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagactgggcttgagcaatctgcctgcctcagcctcctgagtagctgggactataggcgcgtgccaccatatctggttaattttttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagtgtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgactgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagccacaatacccggccaccagcgataaattcctgttttcaagtattgtttcaaaaattgccaaggtgattttttaaaaagatttacagtattctccctctcataaccaacttaattaagcatttttgattttggtaacccaaacgggttattccaggggttggcaaacgtttctgtaaaaggccaggtagtaaatgtttttggttttgtgggccatgcaatttctgttgtagctgctcagctctgctgtcatagcatgaaagcagctgtgaacaatacgtacacaaatgggcatgtctgcatttccatagatgtttccttatgggcactgaaatttgaattttatggttttcacatgtcacaaaatattgttcttcttttgaatatttcaaatcaaaagattttttcacctttttcaatcaattaaaaatgtaaaaaccattcttaactcatgtgccatacaaatgcattcactgggctgcacgtgacttgcagcccagagttttccaaaccctgatctactctgttttctgtagaatccaatccagaggtttatttgcttctaggggagtctctgtgccatgaacagaattatgattaaatacttttctcttaaaaatatagcccaaacccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaaggtaagtgaaagggaaggaagatggggtggggacccatgtccttctggggacagcaccctactctctaaaataaaattgcggtgggaaaaaaaggggaactggcctttcttgaatgttctcatgtgccaggcacttgacattcctttaatcaataggaaataacttctaataaacaataagcttatgaaatagagattttaatcccattttacaactgaggaaactaaggctctgagatcttaagtggcttgatcagacccacagcttatgggagacagagctaggcatcaaacccacttcacacattcccagaacaggtggtggtgaccacaggtttcctgccgctggccaggtgatgccaggtggtggaaaaagcccaggtttggctcagtttggctcattaaacatgcattgagtatcagctgtatcttaggcatcgtgctaagtctgagggatacagaacccaaacagaaagctgcccttgcagagcacacagctctgggagaaagagatgcagacctggagttctgacattgtgatgagcaccacgctggtatgacgggagcacagagtgagtgtgtcccccgtctgggtagggctgggcatgacaggggctctttgcacacatcctctttgaagaacagagctgtggatgacagcacatgctttcttttcctcctccctccctccctccctccctcccttccttcccttccttcccttctcttccctccccttcccttcccttttcccttttccctttcctcttccccctttcccctttcccccttcccttcctttcgtcttgttcccaggctggaatacagtggcatgatcacagctcactgcagcctcaacctcctgggctcaaatgatcctcccatctcagcctcccaagtagctgggatcataggcgtgaaccaccacacttggtgatttaaaaaaattttttgtacagatgaggctcttgctgtgttgccctggctggtcccaaactcccaggctccagtgatcctcctgcctcagcctcccaaagtgctgggatcataggcatgagccaccacaccacacccaacagcacatgccttcattactcttgttcctaaagccagagaagagacagctggtttcctctttcattgtgttaaaatcatttgttaaaatcattatgttaaaatactttaaaagcccctcctaaagaactttcttttatggaacctgggattttgttattatagctttttttttttttttgaaatgaggtaaaacccataaaacataaatgatcattttaaagtatacagttcagtggcattacatacattcacaatattgtgcaattaacacctgtatttagctttagaacattttcatcccccaaacggaaatcccatctccattaacagtcattccccatttttccctcctgcagccccggcaaccactaatctgtctctagattcgcctattttggacacttcatataaatgatatcatataatatgtggcctttggtgactggcttttttcgtttagtgcaatgttttcaaggttcattcacattgtagcatgtgtcactacttcatttttatggctgaatagtattccattctatggagatcccacattttgtttatccactcatcctttgatggacatttgtgttgtttccaccttttggctattatgaataatgctatcattacttacttaaagaaacttttattagagtatatcgttcatatagagaagtgtacagcttgatggagtttcataaaacacacacacacacctgtgtaaccagcacccaggaccagaagcagaacattatccacctcccagagcccccttttgtgttccattactattgctttctgtgtggcatttctatgaattgtcttttaattttatttatttttattaaaaatataaaatagagaccaagctccctatgtttcccaggctggtcttaaacccctgagctccagtgatcctcctgctttggcctcccaaagtgctaggattacacacatgcgccattgtgccctgcctgaattgtcttttttttttttttttttttttggagacagggtctcactctgttgtccaggctggagtgcagtggcacaatcatgggtcactgcagcctcgaccttctgggctcaagtgatcctcctgcctcagcccactgggactacagacacgtgccaccatgcccagctgatttttgtattttttgtagagatggggtcttgccatgttgaccaggctggtctggaactcctgggctcaagtgatccgcctgccttggcctcccaaagcgttagaattacaggcgtgagccatcacacccagcctgaattgtcttttttttttttttttttaaatttaatggtcgggcatggtggctcatgcctgtaatccaagcactttgggaggccaaggtgggtggatcacttgaggtcaggagttcaagaccagcctggctaatatagtgaaaccccatttcttctaaaaatacaaaaattagctgggcgtggtgacacacgcctgtggtcccagctactcgggaggctgaggcataagaatcacttgaacgcaggaggcagaggctgcagtgagctgagatcacgccactgcacacgggcctgggcgacagagcgagattccgtctcaaaaaaaaaaaaaaaaaaaaaaagaaaaaaattctaagaagttgtttacttgagtgtgtcatagtggtcaaatacaaacctgaatttgggccttaagaacaaggatgagtaggccttattaaacagctggctgtctctgatctgtcatctcctagcaaagggatttgttttcatgtctcaggaagatgctggtaacattttatgatgcttgctgagaaaagtctcctttgatgttacagggatataaatgatgtagaataaggggaagctcagaaaggaatgatttcctaaggagtattctgactctagaaatcacacccaaggatccaaacttcacttgaattaggttaaagttctgcttccatcctcagatgggtaaccacctggggctggctggcatcattgcagctgctgcccatggtcagcggtcacgtgtcatttcagcgaacacagggagtcaggcttgttctatagtacatgtgtggtcattagataaactaaaatgtatcttcatccagcagggtagagaacacgctggtaccaagatctcttagtttacattctatttctttgctgcccctatcctggcttgaaaatattcagaatacttattagaaaatgtacttcattaggaagagggaattgcctccctcgtctctctctgacaggtattcagctaccacctactagagagggcagggagccattgaagtgctttctggaagatccagggtggctgcaatgatggacttagcttctttattttacctgggagcagtcgcaggcccttcttttccattttcatgctgtggcttgacatttaattttaaaagccattctgaatgacatggcaaggggcgagagaaagtggtgtctcaactgacagatgctcactttgaatgttatttgcagtggggcttatcattctttaatccacagcaggcaaacccagccagcttttgaaggagagggaatcaaagtataaaattgcgtcctctctaagttgcagtagatatgactgactaggcaggtcaaattatttgtcccacctttccccagctgacctattttgcagagttgcacctcctctgaagactgaagctaaatgcaagcccgtcgagggggaatgtgtttcttgggggtcgtgaagcggggacttggtctttttccctcatgttgcttttctctgtgtctcctcaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaagtcttttgcttcactttgtgatatgatgtcagattccacagttagaggcccttgtgggtaaatgtgcagacatcgctgaaaccaattgcgtgagatgattttcctcttgtgtttgaatgacaatcagctgcactgaggggcaggctgttgagttgggggaggggagtatgggatgatgcccaggtcagggtgtcccaacgacaggtggatcagagaagcaagcccatgggccccatcagccgagggatggctccaacagaagggtaaacaggaggtaggagaattcctaagacagaggggcctagggctgcgggctgagggccagaggtctggttgtgagttgctgggaccccaggcaaggagaagctgtgagccttggaggggtagagtcctgctgggcctcaaggtggcaggggcaaggaccagcatagcacatccacgggcacgctcaccatccttgctctgtgatctgtacaacattccagcatctcatgatagaccagggcccatggcgtggctcccatgtgcacacgacagttttactatatatcttctagagtattcttgaagcttgtcaatgggactttccctggtctgatgttggaatggcccactgttaatacatctccaccaggcaactgcttacttctctccctgtcctttgtttcctgtttccaaggcacctcccttaaacctcttcccagtgttacatagctttaaaatatctttaaggcatcttcatcaaaggctttataacaataagttgagataagctatcctctcccattttagcttgacactcaaacatttttacctcccccaaagtaaaaattgattttgtattttagacaccgtagcaagtttgtgcttaagtgttcggcgatgcttctccttattataggtcctgttgcttaacgggtaggtaggtgcctttgtgtaaatattgccttataaataatgaggtttttttaaggttaagtaggattgggtttgtttaaaaatactgtaatcagcagcctttaaaaattttttcattccctaggatcttttaagcaaaggttgaaatttaaaaactaaggtaataaatgtcacagaatctattatctattgtatagctccaggcacacctgctaagaggcagcttactaattttgctgaaacccattactgtaatcaagtgggaagcagtaattgtcatcaaccagttagagaagaaatttaagcttaccaaccaagtactcttctcgaagctatgtttggaatgtctgaagaggcaccacacggtgtaaatactacctatatgctttcaatcagaccgataataatatagaaggtgctatttacatggtttgtgcagagggaaggagtgttttgctctgaggaatcagaaaagctgtttttctggcctgtggaaatagaagagcccctgtactctggtggagaaatacaggtgcatgacctgtatttgaggaatcttgtgccattttatgagtatagaaatatgacagcatttagctagacactatcccatgccaatttcacttcctagaggaattgggagcaaagattatagacagatccaagatagtatggatcagaaaagaaaggtaagtgaggtaaataaggatttttcttacatatcatgtttaaaaattgtagcaactgctcacatgaagctgaaaatgttttgttatgttttggaatgccaaagcatggcgttatctttgttagagagcacgtcgttagcaccacctaggcaacgtgactctcttcaccatcacatactagcacacggggctgtatgcgactcttgctcaagttcctggcaaatgggcctttacctctcattgctctgcaaatatgaggactcgcctgtacttagcagggctcaggtgcttcttgtcttgagttctgcagttaagtagaggttcaaagaggactcagcggggagttgcagagatgattaaagggtggaaagttagagtttcagggaagagttaaggaaactctcaggtttttttggtctggtggatgatttattaggctggtacaaaagtagttgcggtttttgccgttactttcaatggcaagaaccgcaattacttttgcaccaacctaatgattctccagcatgtggaagacgcttagttgcagaaaggggtctacatccagcactgaacaagaagctaagtgtcaggtctgtcagacaagggagaaagaggtttctgcccgggagggctgttagttactggactaggtcatggagaatagtggtgtcatctacacctttctgttggggatgtgtgtgtgtgtgtgtgtatatatatatatatatatatacacacacacacatagagggacttctccatgctttagtagacagacaataacttgtaaaacaatctgctttttcttctgtataatctttacttttttatcatatcatctttgtactacttctgtggttgctttcaattttccattttaacctatctcattaattatatctgtcttatggacgcatttaaaaaaattttttgagacagggtctcgctgtttcacccaggctggagtgcagtggcgcgatcatagctcactgcagcctctacccactgggctcaagcagtcttcctgcttcagcctccggagaagctaggactacaggcttgcaccaccatgcctggctaagcatttttaattaacaggatgatagactattacttccctaaaaacacagttcaagtgggagtactcctcctcagcactgctgacatttggggcttgatgattctctgtgctggggctgtcttgtgcactcttgggtgctgagcagcatcccagggctccacccactggatgtcagcagcacttgccctctcctattgtgataaccaaaaatgtctttagacattgccaaatgtcccctgagggtggaggcagaattgctcccagttgagaaccattgctctaaagccactcaatagcctaatgaatatgtgattatttccaattttgaaaaatttcttggcctatcacatagtttgtgaaatttctcttacccatactttattatttaccatctctacatctggcatatgaacatattgcttctaggaaatggaatgttgagtaaccttagcaggtgctcataaaatatacattccttcatttttttttttttttcactaagtcttgctctgtttcccaggctggagtgcagtggcgacatctcggctcaccccagcctccacctcccagattcaagcaattctcctgcctcagcctcccgagtagatgggactacaggcgcatgccaccaggcgtggctaatttttgtatttttagtagggacggagcttcaccatgttggtcaggctggtctcgaactcctgatcttaagtgatccgcccacctcagcctcccaaagtgctgggattacaggcatgagccactgtgcctggcctaaaatgtacattcttttttaagagctgtggccactgagactcattctagtagaatatatgacaaacctcctacattaaagacagttttaaaaacagtttaactatttttaaaacatttaaaaatgaagtttattacattttttcaaaatgaaagtaatacacactccaaatattggggaaatcagaagaaaaaggaaacatttaaaaagccacctacattcttatcaccaaagaagacatgattgatatttagtgcatttcctttttgtcttttaggtcttttaaaaagatgcattttcggttgtattgttttggtttctttttcaacacagactcccaagtgttcctagggtctgtgggtctcttttcttgtagcactggctcatcccctgggtgaggagttagttggtttatcctttcacacaggaaatatttcttaagtgtccaccatgtgctgataccatcctagaagctcagagtccagggatgacagcacactgcctctgccctctgtgaacttacatgcaggcattttggtgtctgatgatttctggtccaaactgagagcagatgtttcaccctggtagagaattgcaaagagctttcttgctggttgttcttccattcacaggcttttgcctgttcttagcacctctacccacaaagtttgaagcctcctgtaagtctgtaatagagttccaaagtggcctagcagaacctttctgaggagagtagcagttgccactgtgggaacagcaaggtgcatagctcaggcttctggctctgaccctagctgatgcctatatttttgcttggcagtaaataccttgtgtgctttccttcctgatgcctcctatgtgagataggttcagttttatgtggcaggcagaaccagatacactgacatttagtagacctactcatccgttcattcatatgtgcatttggcaaatatctgttttgtgtctactgtgtgttaggcattgtccaggcactgggagtgcactggtgagcaagagttcattgagctagtggctgttagaatcagggcttctaacccaatcagtaggttcaaaggagatataagcatgttatttattttattgtagcaagtggatcgaccatttattaaattgtatttggttttagaaggggttcagcaaatccatgtcatcaactcttgattggggtttgcaacttgatccaatcctgacattcactcagtggttgaaattgatggaaatcctgttagtgggactttaagagaatcggctggtctatgggaatgagcaaataagtgtgtgttgccagttgcctccctgccttagtgggtaaggacagaatcatcttggtttaggagagaagtacgtagtatatatcgaacagtctacatttgaaaacgcgttgtgcctcagagtcgtctggtatttgtggcagaatcataccccatttgatgtaacttgatttaacctgacccatgtaatgtgaaggcatttgcccagcaggccctctgttcctcttttaaacagagaccctttttcagactcagcctgaccccagatgctgccagttttccattagagtactctattgcactaaatggccttagaggaggcagttagaattttatttttgaaagaacaatataggtgaatagtagtctttgagaaggtaagaagtgtattatgggaaccaggatccattttaaagcaagccttgctgtacattttccctaaccttttcccatgaaccaaaagaaagattaaaattccaacagaaggaaaatcgccttggagaaatatcttgagaccgatggatttatttcatgtgtggcttaaaatagcctgggtttctagcaccgcgttaagctgtatttctaatgagttcctgttaccctacttttcttcagctttctttcacatggccttttctatagacagaaataggctaattgctaccataacagttttactatctttctttgagggatccacaaaatggcccatttttaagacaggagatccgaagggttgaggggggatgcagcttttctggggttgtttctttggacccaagggtcgcgtttgggattgagctgcatttctgggctgtgagcctgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgacacttggcttagggaggaggttctgctataacgtgatgtatgcggtcctcaaaatcacagcactacgcaaaaagtgctccatgcaaaccacaggacttgtgggaaaaatggggttaggtacacaacagtcaaaaacttcatcagtgatatatgacataaaagaggtggaagcctaataagaatggtagtaccgagccaggtgcagtgagtggctcgtgcctgtaatctcagcacttcgggaggctgaggtggaggatcacttgagcccaggagttcgagaccagcctgggtcgcaagaccctatctctacagataaatttttataaaatcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatgattttacctcccagagacattgggcaatgtctggagacaatttggggtgtcatgactggagggagggatgctattggcatctagtgagtagaggtcaggggcgctgctaaacatcctgcagtgaacaggacagctccacaacaaaacatctggcccaaaatgtcactagtcgtgcagttgagtgaccttggactggatgtgcctgtatagccaaatgagcaatcctattcattccactttcttcctgctgtcctggtagcaagcacacagggggacaggctttgcaatttgcagatttacccagagaactcctggccagcagagtgagcatcctccttagctctgactacagacagagcagtgtcttgcatgtgggaggtgcaatcaatagggaaaaataaatgagtccttgtgtttgacaaggctagggatcatttctgctgatgaattttaaaggagctcaagtggtttttcaaacttgagtgtggatcaaaataccctggaggattaaacctccaggttaaatccagatttctgggccctgccacagaggtactgatccctggaagtctagggtgaggcccaagaatattctttcctaacaagctcccaggtgatgctgcaactgccggtctggggaccccaccttgagaaccactgaagtcgatttatgcacttgagtttccagtactcttggtataaacaccactgtgattgcccatgctgtctcaagtgtgtagcagtttctcctttcctttaaaacaataatccaaagtcaattatcgttggaatttcagctcaggcaggaaactctgcccttaatgcccgctcacacctcatagagccccatgaggtcttcctgtgaagatctgggtgccgaaattggctctgaatgtgcttcaagaaagcaaaatcgcactctctctcgctctacatcttttacacaaacacagatgctgctgcgttagtgctggcaagggatgcttgtctgcggggcctttcatctccttgggcttcttgccagggcaggcacgtctctggccagctctcatgtttgatgtgctcgcccaccctgtaccttccctgctcgggatggccacgagcctgagctccaccgctggcctggatcacctgcagcatttctcaggcctggggttcaaggggcatcataaaactggaccaggaatcggaatgccgcaatctaggaagcctccagttgctaagagtgaatttgggtgagattttccctatgaaagttctagaaaggaaaagtgagtaagggagatggtgtcagattttccccaagccctgctaggtggtccacaggggcctggacaggatagctttcgcagaagagcccagctgctcgaatttgaattatgtccttggtcatagatctggccatttataattcgctgaattcgcttcaactgctactcaaaggggctggaagttcaaacacttgatttaaatcaaataggacatttcatgccactaacgaagcctgctggatttgatgttacctccttctgggttgatgttcagctttcttcttttgtgataattaccatcgcgggccagggcacaatttatgcacgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtagccccatatgcattagctatttatcctgatgctctccctccccacatccacgacaggccccagtatgtgctgttcctctccctgtgtccatgtgttctcattgttcagctcccacttgtaagtgagaacatacagtgtttggttttctgttcctgtgttattttgctcaggataatggcttccagctccatccatgtccctgcaaaggacatgatctcattcctttttatggctgcatcgtattccatggtatatatgtgccacattttctttatccagtctatcactgatgagcatttgggttggttccatgtctttgctattgtgaatggtgctgcagcgaacatacgtgtgtatgtatttttataatagagtgatttatattcctttgggtatatactcagtaatgggattgctgggtcaaatggtatttctggttctaggtctttggggaatcgccacactgtcctccataatggttgaactaatttacattcccaccaacagtgtaaaagcattcctgtttctccacactcttgctccacaccagcatctgttgtttcttgactttaataattgccattctgactgatgtgagatggcatctcattgtgggtttgatttgcatttccctaatgatcagtgatgtggagctttttctcatatgtttgttggctatataaatgtcttcttttgagaagtgtctgttcatgtcctttgcccactttttgatggggttgtttttttcttgtaaatttgtttaagttccttgtagattctgcatattagacctctgtcagatggatagattgcaaaatttctcccattctgtaggttgtccgttcactctgatgatagtttcttttgctgtgcagaagctctttagtttaattagatcccatttgtcaacttttgcttttgttgcaattgcttttgaggttttcgttatgaaatctttgcccatgactatgtcctgaatggtattgcctagattttttttctaggctttttatcgttttgggttttacatttaaatctttaatctatcttgagttaatttttgtgtaaggtataaggaaggggttcagtttcaattttctgcatatagctaaccaattctcccagcatcatttattaaatagggagtcctttccccattgattgttagctttgtcaaagatcaggtggttgtagatatgtggtcttatttttgagatctctattctgttccattgatctatgtaccagtactgtactgttttggatactgtggccatgtagtatagtttgaagttgggtggcatgatgcctccagctttgttctttttgcttaggattttctgggctatatggactctccacctcaaaacaacagaatatacattcttcttggcgccacatgacacttactctaaaatcaatcacataattggaagtgaaacactcctcagcaaatgcaaaacaactgaaatcataacaagcggtctctcagaccacagtgcaatcagattagaactcaagattaagaaactcactcaaaaccaccacacaactacatggaaattgaacaacctgctcctgaatgactcctgggtaaataataaaattaaggcagaactcaagaaattctttgaaaccaatgagaacaaagagacaacataccagaatctcttggacacagctacagcagtgttaagagggaaatttatagcactaaatgcccatatcaaaaagctagaaagatctcaagtcaacaccctaacatcataactaaaagaactagagaaccaagagcagacaaaccccaaagctagcagaagacaagaaataagcaagatcagagcagaactgaaggagacagagatacaaaaaacccttcgaaaaatcaacaaacccaacaaatccaggagttgtttttttgaaaaaattaataaaatagactgctagctagagtaataaagaagaaaagagagaagaatcgaatagacacaacaaaaaatgatacaggggatatcatcactgaccccacaggaatacaaacaaccatcagagaatactgtatcacctctatgtaaataaactagaaaatctagaagaaatagataaattcctggatgcatacaccctcccaagactgaaccaggaagaagttgaacccctgaatagaccaagttctgaaattgaggcagtaataaatagcctaccaaccaaaaaaatcccaggaccagacagatttacagctgaattctttgtaccagaggtacaaagaggaactggtaccatttcttcagaaactattccaaacaattgaaaaggagggactcctcccgaactcattttatgaggccagcatcatcctgataccaaaacctggcagagatacaacaaaaaaagaaaacttcaggccaatatccctaatgaacattgatgcaaaaatcctcaataaaaaaaaataatggcaaactgaacccggcagcatatcaaaaggcttattcaccacgatcaagtcagcttcatccctggggtgcaaggctggttcaacatacacaaatcaataaacgtaattcatcacacaagcagaatgaaagacaaaaaccacatggttatctcaatagatgcagaaaaggccttcgataaaaataacatcccttcatgttaaaaactctcaataaactaggtattgatggaacatacctcaaaataataagagccatttatgacaaacccacagccaatatcatactgagtgggcaaaacctggaagcattccccttgaaaaccagcacaaaacaaagatgctctctctcaccattcctatttaacatattgtacaattcacccatttaaaatgcatgattcagtggtttttagtagaaaatgggttgtgcattaatcaccacaattttagatcattttcatcaccccaaaaagaaaccccacaccccttagctgttacctcctataccacagtccttggcaaccactactctatattttctgtctctgtggacttgcctattctggacatttcatgtcaatacagtcatgcactatgtggccttttgtatttggcttctttcactgagcatcatgttttcaaggttcgtccacactgaagatgtgtctgtacttctttccttgttagggctgaatcatcttgcattgtgtggatagaccacattttgctgatcaattcattagttgatggacatttggtttccctttttttcttttttttaaattatttttaatttttgtgggtacataggagtatatatttatgggtatatggtatattttgatacaggcatgtaatgcataataatcatatcagggtaaatggggtctcccagcacctcaagcatttatccttcgggttacaaacattccaattcttttagttatttttaaatgtacagttaaattattgattgtagtcaccctgttgcactatcaaatactagatcgtattcattcttttaaactattttttgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgatgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtgtctagctcagtggctataaaccaaccggtgtagaactattttagtactttttaatctggatggtggttctcaaccaggggctatcttgtcccccctccacaggagacatttggcattgtctggagacattttggttgccataatgggggatggggatgctgctgcatctagtgggtagaggcccaggatgctgctgtatgttctacagtgcacagaatggcctatctgcaacaaataattagccaacctaaatgtcactagtgccaaggtggagaaaccctgcgtaaagccttcccaggtggagggctggatgggtggaaggagtcctattggcccagcttgcattttgctgctaccgcatgggagggggcctcactggggattcctatctgcctgtaaatagaggcccttcccagtaacaaagccgcctttcctagctgtcactgctttcttgaaattaattagaattatcagagctagaacaaaatttcctgactctgggaggaaaccttgtttaaaaacatttatttaaatttttgtgggtacatagtagatgtgtatatttatggaacacatgagatttttaaaatatatatatatatatattttattatactttaagttctagggtacatgtgcacaacgtgcaggtttgttacatatgtatacatgtgccatgttggtgtgctgcacccattaactcatcatttacattaggtatatctcctaatgctatccctcccccgtccccccaccccactacaggccccggtgtgtgatgttccccttcctgtgtccatgtgttctcattgttcaattcccacctatgagtgagaacatgcggtgtttgtttttttgtccttgtgatagtttgctcagaatgatggtttccagcttcatccatgtccctacaaaggacatgaactcatccttttttatggctgcatagtattccatagtgtatatgtgccacattttcttaatctagtctatcattgttggacatttgggttggttccaagtctttgctattgtgaatagtgctgcaataaacatacatgtgcatgtgtctttatagcagcatgatttatattcctttgggtatggaacacatgagatgttttgatactggcatgcaatgcataataatcacatcatagagaatggggcatccaccccctcaagcatttaccctttgtgttacaaactatccagctgtactcttttcatacacctgtttgctatttgtatgtcttcttttgagaaatgtctatccaaatattttgcccgtttttttgatcagattattagatttttccctatagagttgtttgagctccttatatattctgcttattaatcccttgtcagatgggtagtttgctagtgttttctcccattctgtgggttgtctcttcactttgttgattgggaaacctttatttcttatgtgggcctctggctctgacatgcctcaagtctggaggcctggactgctcttctcagcagcaatacatggctgccaaagcaaaagggcaactctaatgagaccggggcccactaaagcttttgcaaccgtagaagcagggtgatttggcgaagtattgggtaacagtgcccttgagaaaatgtgtatctctggttgattgattgcaatgggccctcattatgacagttgagcccgaagcagctaaaacaaatcaggatggaaagaaatggtttcaggctctgccagctggacccagcaaccttcctgtgtgaggagaccagagcccttgttgggccttgaatctgtcaactgtgttcatactcacagatgggttttcccaggagaactcagcatctcaccgcaaagaagagtgctaacatttgtttcctttaggtagctcttgtttcaggattataacaacatttaggcttacagaacaattgagcaaaatatgcagagttctcatatatccccttcactcccctcagtttcccctattgtcaatatcttgcattactgttgtatttgttgtaattgatgaaccaatatcaatacattattattaactaacatccatagtttactttagagtgtactctgtgtcatatatttctgtggattttgacaaatatataatatcatgtgtccaccattacaggatgatacagagtagtttcactgccctaaaaatcccctgtgctctgcctatttatccctctcttccacccaccaaaccctgacaaccactgatctttttactgtctccatagtttagccttttccagaatgttgcatattatgtagttggaatcattcagtatgtagccttttcagactggcttctttcactcagcaatacacattttgatttttctccacgtcttttcatgacttgatagcacttttgtttttattgctgaagaatatccattgtctggatatgccatggttcagtttatccagtcacctactaaagaaaatgttggttgcttccaggttttggcaattatgaatgaagcagacgtcttctaagacgttttctttacataactaccaaaccatgatgatgtaaaattaacagtaactcaatatatcatccaatatccagttgatattcattcaaatatcaactcagaattccatcaaggtttgtgcattgcattcttttgcctttttagtctcttgtctagaacagtttcctgccttgttgttgtttttttaatgagagatttttaaacataattccaaattttattttagacacaggagatacatgtgcaggtttgttacttgcaaagatttcctttgaagagtccagaccagtagtctcacattctgggtctgattacttcctcatgattcagtttggcataagtcgtttttggcagcattccaacataggtaacgctatggagtctgcttttctgactttgttgatgataagctccattgctcggatgaggtggtgatggccagaaccctccattgtaaagtgacatttttctctttgttcataatctgtaggaaagtactttgagaccatgtgaattttctgttttccagcaaccattcgcccagtgattttggtatccattgacaattattgcctaagctaactattacattgggggttgcaaagtattaattatcaaattctgtcctgcttcctacgtttatcaagtattcctccccatttaagaaaaacaatccctgtagggtcatgatatattcttttaatgtttttgtaattcatattgtcattattctgtttgcttagcatgctctttcactattttcctctctcctaaagatgttgccatgagatggaggggaaggggtcttatttgctgtctctctcagtgtgatacatagggaaaccaacacaagaaacggataccttttccaagactgtttaaggtccagtgttgtcagagccaaaaaagtcagaattctggcctgacagtttgaataatcagtgtctatttcaccaggtgtaactgatttgaatactgcttagaatacttacatcccttcttcatattcactaagagataaatttgactaattttgccttaattaaataaatgacagtatattacagttaggttttctgatttcttttgtatattatcatattacacagagtagaaacccattattttaatagctataaagtattttaatgcaagactaccagagtttgcttctgcataccccttttttggggggtacagtggagatacagtgagtagtgttttgcaaacttatgtgggaatggagcttctttttttccaaagaagttgttcacttctccttctctcagacctttcattttacccaagggacatgatgtgttcctgcaggtggtcatttagtaaaataatgaaacaaggcttgctatgaatggttgtgcaaatgtgcactgtataatccagagggcacaatttctactgcagtgtttgtgagcagtgctccttggcactgtgtgatatacagtcttggtggtcccatacaatggactctgggaagtggcattctttttgtaagttgaaagcaatggaattttggaagagaaggcaatttacgtatatagtcagagataaatgtcaactttatcctcccagtaagaattacaaatagaatcactttttatcttgtacttaaaatttcttatacttaaaataccttacacttggcattcctgtggtgtggtcaagttttgacaatgcctttcataaacccttttaaaattgattatagtcttgaaatttaagaggatatagtagtcatcataggtttactgccgtaataaacaagcttgcaatctctgtggcctaatgcaataaaggtttatttttctcacatgttacatccactgtggattgcaggtgggctctggacctaggtgtttgaatctggtggctcctaagtcaatcctcagagcccttcactggctcctgtgcctctggctgccagatgagaagagagagtggggggaaatgcacaggagacctgggagcagcatctgtcacttccacccacaggcattggccagtgctccctccattggctctgcctaaccacaagggaggctgggaaatgttgtctgtctctgtgtccacatggaaaaggcactggggtttagggagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaacgtgttggtttttttttattgtaacactctgtgtaaacgttgacaccttattaaatattaaatgtctgaactctatttttaaaaataaaacaagcacagagtctgcaacaaacatgtaaatggaagagatactgatttcacagtgtgtttctacgcagtagaacctctggaaacctggtccccatgacttggtagaactatccagtaaagttaaagagccatcttaagacgggcacacagattgtgaagtccatttagtcagctttaaaattccttgttcttggctgggtgggcggtgaccaaatgaaaattcagactgaggctatcagtttccaaggattgggtaggaacactgtcctcaggccatctgtgcttgccctgtgtgaaggctggggagtacggcttgggtaatggtctaacattcattcattctttcatcctttctttcaggagcaaattttccctttattactttgggaaccacaagggttgaattatgtcttttcccacaagtattttttctttttttttgtgaaaactttctactttacagaaaatttgaaagaaagaaaagaaaggaacaaaggatgcccacagatccttgacctagaagaggtgctatttaatatgggtggttagaggagtccccactggttaggggaggggaccagctgggggtacagctggggaaagggtatcctcagcagaggggacagcaagtgcaaatgtcctgaggtggaaatgggcctagcctgctgggggcccaccaggggtggatggctgcagccttgggatgggagtgggggtatttgaagttgggtttgttttccctttgggaggagggtagacacagcagatgcttcagggtcttgaaggaccaggtaaagttctggaattcagaggagtgacatgatttgacttgtgttgtccacaaaccattctggctgttggacagcaagactggaagccagggctccggttaggagtctattgcagatacgccaggtgcggtggctcatgcctgtaatcccagcactttgggaggccaaggcaggcagatcacttgaggtcaggagtttgagacgagcctggccaacatggcgaaaccctgtctctactaaaaaaatacaaaaacaagccaggtgtggtggcaggcgcctgtaatcccagctactcgggaggctgaggcagaagaatcgcttgaacctgggaggcagaggttacagtgagctgagatcgtgccactgcactccagcctgggcaacagagcgagactccatttcaaaaaaaaaaaaagggtctattgcaaataggtgagtgatgatgggggcttgccccagaaaaattcttgaattccagttatacagttgcccctcagtatctgtgggggattgctttcaggaccccccatagattccaaaatccatgacgcttaagccccttatataaaatgttgtattatttgcatatggcccacgtacatcctcctgtctgctttaaacgttctctagattacttagaatacctagttcaatgtaatgctatgtaaatagttgttacactgcattgtctatggaatagtgacaagaaaaaagtctgtacatgttcagtacagatgcaaccatccattttttttcctgaatattttcaatccacagttgaatccacagatgcagaatccatggatacagagggcaaactgtatttccaaggtagagccaacagatttgctgatggactggttataaaatggtacaaccaagttgccacttactgagatgggctagactaggtgaggagctcccttttggaaatgctacatgagagatgtctcttagacattcaagtttggagctcagtggaatcattaagttttgagatataaatcaagccattggcatatcggtggcatttaaagccatgcctggaaacttttgtggtctcatgatatcctaaaagcaaacaggagaatctttttttttttttttttttttttttttttttttttttttgagatggagtctcaccctgtcacccaggctggagtgtggtggcatgatcttggctcactgcagtctccgcctcctgggttcaagcgattctcctgtctcatcctccttagtaactaggattacagctgcataccatcacgcccggctaattttccatatttttggtagagacagggtttcaccatgttggccaggctggtctcgaatttctgacctcaagtgattcacccgcctcggcctcccaaagggctgggattacaggcatgagtcaccgcacccagccagaatattcttccaacagaatttcaatattgagttttcagggagtcacaccaatgtcacaggccgataggactgcacttgagttccggctccattgagtcctggctccgtgtgccattgtcaaagggactgaacttctctgagcctgagtttcctcatctctgtagagtgagctactgctcttgccacagcagcatggctgtgagaattaaatgaggtaattgctgtacagtacttggcatggaatatgaccaggcaaatggtagacattatcatctaaagctcagtagctttagttggaaatacttcaattaattgtgtgttgttaaaggacatataacactttagtttaattataaggccacagaaagtaaacgcagatcagactagccaaatgcttttttcccagtccctgcagtcatttttccaaaaaacaaaacaaaacaaagcaacaactcagatctcttaagggatatatttagaaaaaaaaatctgtctccaaattaatgggaaattatagaaaggaagctacttggtagaaaattccatttctctgtacctttatattggcttgaagagcagaaaagcatcagtatgcatggatactgaactatgaattgattactttgaaatttggagcaagaattcatggaacacaagaaagtgtatagcttgcttattttcaggcaacctaaaactcaataccctctgcacttccagacaaagaaaaatctctccagcatggtgttaatgtagaaatgagtctgttagtaaaactcatgaaagaacagcgttttgtgggccttggacatttccggtcaccatgatgttgttaaaaaccagagggggagaatgaacaaatagaatttgtctgaaaagtgacagcccatcagttttaattctggaggcttagctagagctaaccaggatggccttgcaaataaaagtctgggtcatgcatgggtttcctgggctttcatgggttgagaaaggactagaaacgtccatctccatcaatttccatcaggaccagtgtgcttcagctgagcacggggtgcctggactgcccattgttaaagctcttccccagttcattggtggtcaattggccagaaagaagctaccatatgtgaaggcagatagggagcatctatttctggctgttcctcaacattgcatttcattaaagacatgttttttctttctgaatgagcaataagcagagagcaccttgtggggatttccaaacccctttagtcagggcttggctcacagaacgaagggagcaattgatgtgtgattccagcgcttgttatggaacacatatttcaaagatgaaacagccttcctcaatccaaacagactctctcagagaaattgaaaacacatccataaattctcgtcccacaggctcctaacaggttggatccaggggatgctcgctggtagaacattccttccttctgcagaactccatgttcatttcacacacactcactctctcagggcttccacctgtttccagttgatacgaacccaagtggaaattggggcgggctagctcccttttgatgaaacaggtttccttttcttacatttctcaaactttagcctctccccagaaagacatttctaggaatggctgctgagtggtttacatgatcagcaaggaactttctccagggagtggccaagccaagttgctccatggggcaggagtctccactggttattaaagagctagggagaggccaggtgtggtggctcatgcctgtaatctcagtgctttggtaggctgtggtggttgaggattgcttgaggctaggagttcaagaccagcctgggcaacacagacccccatctctacaaaaaaattttaaaaaattagccaggtatggtggtgagcactggtagtcctagccacttgagaggctgaggtgaaaggatcgcttgagcccaggagtttgaggctgcagcgagctatgattgcaccactgcactccagcctgggcaacagagcgagactctgtctcagaaaaaaaaaaaaatgctggggagaaagagcaggacggcattcagtggagatgatttcccaaagtgcctccagggtacagtgtctgcaggatgctgccaggtgccagaggaagggtggatctgtggttaactaagttggtggctagagcgtgagggtccatgaagtcttttttaagtttcttttgagaatttctagttgagtgactggaagaaccgacttaactttaacgcactgcagccacatcatctgaaagcagtgacttgctaatcagagtgtgatctagggactacctgtgcctgtattactggagtaagtgccacttagcaatgcagaattgcaagccccatccaggtctgctgagtcaggcagaattaaccccaggtgatttgtgtgcagagtacaatttgagacgtgctgccttgcgtgaccaggtgatctgagtttacttctagcgctaagacccaactttctctaagattatcttacttccaaaggaaaaaggagtgatgactgcagtgattgggccactgaaggagcctgtccagagaaacaaggtagggagaagcttggcataagagctctaagccctatttctcagtccccagactttcccagttacagctatcctcctacgtgatgccccatctcagattctcagcctcagcactagtgacatttggggctgtcctgtgcactatacaatggcgagcagcattcctggcctctccccactagatgccatcgcacccctcacctagttatgactccaaaaacgtctccagacgttgccaagtgtcctgggtggggggaggtatgcagatctcccccctcccctcccctaattgtatagaagggagcactgtgatttacaaagcatgggaaaagggatcaccctttggtgtcattttgctggttttttcctaacgctggatgaaaattgctagtgtaaggcaaagactgatggggactcccatcctgcttcgacgagtccccatggctggggaagagttccctcagcctttaagcagaaaacagcaatttagtggggagagggtgcatttccttctttctgagaacctaatggtgagcccaggaagaatgcagtcaccttacctggacataagtctcacgccaattggtaatttcaaagtgattggcttactttcaactgtctgtgtgaccaccctgtcgtccttctcagttgcctcccacactcagaccatgcacgcaagcatgtcgatgaaatcgctctttgctgggtacatctcattagaaagattcctagttgcttttttgagtcaacttgaacatttttgtgtctttctttgaaacttagaggagtggttggccaactatagcacgtggccaaatgcagcctgccacctgtttttgcagctaaagttgattggcacacagccatgtgcagccgcttacatattgtctatggctgctttttatgtttgtttgttttagtctataactgtttttgtgatacaatggtggagttaaataattgcaacagagaccatctggcctacaaagcccaaaatatttactatcaggtccttgacagaaaaagtttgctggctcctggcttagagtaaattggggtcaccaaaccattggatagtcaccaagagtaatttaactttcttagactatatgtaaaatataaagaaatgctttaaatacagaatcaaggagagatgcgtgtgtcagtggaataagatggatttgttaaaatgattttccatccttcaagtttctccaacagcttaacttgtgccagaaatatctgtcctgacttagatattaactgagatgtttatggcctctgtcagaatttaaatatgttttctgtaacagaaaatgacacttaacacttgaatagcactgtgtcatttatgaagggattttaatatttatttgtgtttgtctcaatggttctgtgtgggaaaaattatacctattatttagaagacaaaactgaggttcagaagaatcacctgtggagattttgcaacatactgatgcaccggagccatgccctgagattctgattaagtccatcttgggtggggtcttccatcaacgttataaaaggtcaccgggtgattctaatgtgagattgagaacctctgggctccagggatttgctcaagttaatatacctaggaggtggtcttgttggaggaagctcaaacttggtcttcgtgacttcaagtctaggaacattttcctacaatataacaacccagcttggctcagggtctaacccagtggttctcaaagtatggtccttgtaccagaagcatgaggatcacccagcaatctattagaaatgcaagttatctgtcctactctggacctggtaaatctgaaagtctggggatggggcctactcctctgtgttttaccaaaacctctagccggtttagaggcagctccggtttgagaaccactggtttaatgtgctgggaaagcggatagataaattttaatggaagtaaggggctaaaactggaaaaaaaccacacacacacacacagaaaaccaggccttgcctctgggaaattggctctggctggggaggggcagaatgaacacaagaagttataagaaaagtgaaaatctgtgcacatctggggaaatatgaaggtacccggatggcagaaaaagcaaaaggatctcaccagccctgagttgagcctctgcggagttcatcttcctcttaggcagccatgaaggtgttaagagtttctgcatccctttgctgtgctggcaggtcagagggttttttttgttactgtttcatttcactttttgttttcaaagttttgggtttttctgaatcaagcacttggttgagatgaacattcttgtgtgattaaatgagcccccttctgcttggagccaaagccacattccttgcttcggttttatcccaggtgctcctttataattgcattttgtattccacggtgcagccacccccttcccggagagggctggccccctaatcactacagtgctgttacactgcagctgggacttcaaagtccccagaagtcacattgtaacgtgagctccaaatcgtctctgagatgaacacagagaggcatcatcagtcaaaactcatcaagggcaagggatacctctgtgtggcatgtgggtgacggaattcagcctcaccctcagtccctctcagagcctccccctccacagcattgccattcccaatctgaaaaccacaccaacatatacataattcaaggctgtgcactgatcgcccagagtgaggggacagacatgtatgcccaggaaagaatgtttgtttcaagcaaacgttcacagcaccagctgccaatgggggaagacgggcagagggggctcccgcagacagacatgggaaagtacaaacgatgattacaggctccaaaaaggagctgctgttgggggaaatcacagcatctgatttgggttttgcttttataattactggactcagagaatgtaactgcaaagcacatgctgtttccaaaatgggtgggaccatgtgagctcatgacggtttcaaatctgcactttgacattcaagtttcactccaggagttaacaagagcaggccctgctttacatagtagcttcatttgaagttccaaagctcagtccctggaagcagatggggtaacttgtgattctattttatttatttatcctggagccaataaagaatattgatttctaatgtgggaattctgaaaagggaaaaactagggttgacttttttttggggtcaaacttatgagtttctcaaggccgaagagctgtgtctccattatctttcttcagtgtcagttctcgtatgtcgtatattgacgataaacaatataatgtatgcttttgaacaatggataaatgctgaaagcctgttctttagctgtgaccttttagaataaatcaggaaaataaccctggcagagttttctggagacatggagcatttccccaaaacagacctatctgccactgtgtgaaatgtcacataaaacactaggtgtcaaaagaaaacagtaatcggcttggtgtttcatggcctgagagaagctgcttagttcagatgccctgagcttccaaagaatgaatataaaagtgtaatctgaagacactgtgtgccctggtgtatctttgatcaaactgaacctgcgaagaagtgtggcaggctctaaaagctgtggtgactaaccgctcaggaaacccatgccggtgactttactgaacatgtcacatcaaaggggaaaagtgccccactgactggaaagttcttttggtattcaatgttgagagagaatagaaatgagataaaatttcagtatttctgggtttggttaatagattctctctctcttccaaatataagaactttaagtgattctgttgacttagtagaaaaatatccaaagggcacacctaataacgaggtctaaggggaatgaaaatataaaactatagataagagagagtatcgtaatctttagagaagtagttcaaaaaattttttcagctgtgacatccaagatgatgtccagacactgtgacgggtagaccctggctttgtaggcacatcccaggacactatctgcaacttgactgtgagggagctaagaatatgccaccccaaaatacgctgctctggcatgttgactatttttaattaaagggacttaacaacagaaaaagcaggtgcaagaagttcactctgatcattttgtttcttaaaagcagattaaattctcatgtgaaagacatccttcttacacaaaaagaaataacaatcttatcaaggatgggaagttgaaacagaattccatgcagaccttgttacaataactcttatctttttagcctccccacataatgtagttgcttttttcacaacttaactattccctgtctgattcagtatgtaagtgactgactcgtaactgcttctttgggccttcataaccttatgagggctcctgtgctacgtaaaacttggcattaaatgaatctgtatgcttttctcctgttgagctgtcttattgcaatttaataatcaggcccagcagggaccctagctgctctgggccagagggccaagctctcttattttctctctcctcccttctgagggcctggctccattccaccactccttctatgcttgagatagaaaatgccatttccctccagtctgtgccagccaaagtgtccccagtcaccttggattctcacattcttcagagggaagcaactacaagttaaatcagtccctgtttgctaaaacccatcacttcttatgagttgtgttgatggggccattcattaaaacttcagcatcactcatttggggcaagagagctgggaggggcaggtcgaaaactgtgtcttgccaaaggaacatttctttagctggtatctgatttaggatcataacacctctggccaccattttttatagaggtaaagccaggtgtaaatgatctattgaagggctttaactttggcataagatggacatggttttgaatccaggctctgttacttcctagctgtgtaaccctgggcaaatcgtttaacctctctaagctttgattttctcatctataaaatatggtaattcgtctacccatacaaacttgttgggcacagcagatggcagagcatgaatgcccaaaaatgtgattgtagcagagatagctgatgctcaccaaatctgtgttctccttttcttcgtgggtccatagctggactgtatttcccagctccccgtgcagttaggtgtggtcaatactggttctagccaatggaatgtaagcaggagtgaagcctggagagcccatcagcaatcccctgcagtcttcctctctgctggtctggaatggagatgacccagcatgaccttggaagccatgtgttgaagatggcagctctgctgtcagcctgggcctcttaataactgtggaagaggacttcccagtgacttctttacctgcccagtactgtcatgtgaataagaaacaaagctctgtggtattgagccattttccactttggggtcagtctgataaagcagatagtgtacccagactatgcagttattaccactataaattcctagaatgctgggtagtggcgtgatgaagctagcttgtaccagctctcaagagctgatggttacatttgcaggcgttttatgggccagttgatgtcacattcctaccttgaaatcagccatggtggaaatgtttacaccacagaaattggcaaatactgtaaaccagtctttcctcctctccctcactggagcatttactagcacactactgactaagaatatatctttttcctctttgccttatcccaaagcctcataacctagtgcattacatatttgaataactcacaaagtgtttgtggctacgactcaagaccaggcttgaataaattgaaagaggagacattgtgaaaggacgaaagctaatacttagggttagacagggcatatggtgaagcgggaagaacagtctaatctttgcctttctgaaataggaatatctggggctaaggatacattttagtgtgttgggtctctttgtgattcaggcctttaacctctttcatctcccctgtctggactggttgtcactgctccatcagcaagtggatgtcttccaaagtacagtgattctcccctcactcccaagcactccataatgacaggcactggagaaagtgttttatccccttcatgttcctctaagggaggctgcagccagtatagagggggctgtctcagtctgggttcccctaacagcagaatcccctgtctcggggtattcaagtgcaagtcatttatttggaaggtgatgccaggaaacagcatggcagagtggggaagaggtgaaacagagaaggaaaggcaaccaacaaagcgtgctttcttcagcaaatcgctgctgctgttggctgctggagatagtttagaacatgtgtctcagagttatcactgcagaaaggaagaagggtactaaggtatttattagctctcttgagtcaatgtggcgccatctgcctaagatgctcataacctgtccagacaaccagactgtctctgttctttcattacctagcccctgagaatctccttactccaccaagacttccttgcttcaccagaggtgagctgactcctttattcagacctctcagtatggatgtcacgtgtattctgttagctgcccttggccctgactctcataatatattcaccctgacctctgtgtgccttcagtgcccttcagtgcattcatggataagaagaatgctttgaatcacaatctcaaaaatgacataactggagggttcttctcttatgatccaacatgattctgaccatcctggattagatatacatttcaccaggatttctgcactgtggtagacacaaaaatcacccccaaggatgtttacatcctaatccctggaacctgtgaatatgttaccctacatggcaaaaggactttgcagatgtgatgaagttaaggagcttgagactgggaggtgatcctgggtggaacaaatgggccaatgtgatcatgaggatccttagaagaaagaggcaggagggtccaagtcagaggaggagatgtaacaatggaaatagactagagtgatgtggagccatgagccaagaaacgtgggaagcttctaaaagctagaaaaagcgaggaacagatttctcctctaaagtcccaagagagaatgcagttgtaccaacaccttggttttttttttttttgaaaaaattttttttaaattttattattattatacttttagggtacatgtgcacaacgtgcaggtttgttacatatgtatacgtgtgccatgctggtgtgctgcacccattaactcgtcatttagcattaggtatatctcctaatgctatccctccccctccccccaccccacaacagtccccggtgtgtgatgttccccttcctgtgtccatgtgttctcattgttcaattcccacctatgagtgagaacatgcagtgtttggttttttgtccttgtgatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgggtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtcgttttgatttgcatttctctgatggctagtgatgatgagcattttttcatgtgttttttggctgcataaatatcttcttttgagaagtgtctgttcatgtccttcgcccagtttttgatggggttgtttgtttttttcttgtaaatttgtttgagttcattgtacattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatagtattgcctaggttttcttctagggtttttatggttttaggtctaacatttaagtctttaatccatcttgaattaatttttgtataaggtgtaaggaagggatccagtttcagctttctccatatggctagccagttttcccagcactatttattaaatagggaatcctttccccattgcttgtttttctcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttgcgggctcttttttggttccatatgaactttaaagtagttgtttccaattctgtgaagaaaggcattggtagcttgatggggatggcattgaatctacaaattaccttgggcagtatggccattttcatgatattgattcttcctacccacgagcatggaatgttcttccatttgtttgtatcctcttttatttcattgagcagtggtttgtagttctccttgaagaggtccttcacatcccttgtaagttggattcctaggtattttattttctttgaagcagttgtgaatgggagttcactcatgatttggctctctgtttgtctgttattggtgtataagaatgcttgtgatttttgtatgttgattttgtatcctgacactttgctgaagttgcttatcagcttgaggagattttgggctgagacgatggggttttctagatatacaatcatgtcatctgcaaacagggacaatttgacttcctcttttcctaattgaataccctctatttccttctcctgcctgactgccctggccagaacttccaacactatgttgaataggagtggtgagagagggcatccctgtcttgtgtcagttttcaaagggaatgcttccagtttctgcccattcagtatgatattggctgtgggtttgtcatagatagctcttattactttgagatacgtcccatcaatacctaatttattgagagtttttagcatgaagggttgttgaattttgtcaaaggccttttctgcatctattgagataatcatgtggtttttgtcattggttctgtttatatgctggattacatttattgatttgcgtttgttgaaccagccttgcatcccagggatgaagcccacttgatcatagtggataagctttttgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttagggaggattccctctttttctgttgattggaatagtttcagagggaatggtaccagctcctctttgtacgtctggtagaattcggctgtgaatccatctggtcctggacttcttttggttggtaagctattaattattgcctcaatttcagagcctgttattggtctattcagagattcaacttcttcctggtttagtcttgggaggatgtatgtgtcgaggaatttatccatttcttctaggttttctagtttatttgcatagaggtgtttatagtattctctgatggtagtttgtatttctgtggcatcagtggtgatatcccctttatcatttttaattgtgtctatttgattcttctctcttttcttctttattagtcttgctagtggcctatcagttttgttgatcttttcaaaaacacctttgtttttaactcataagatccattcagacttctgccttctggaactatgagataataaatctttgatgttttaagccgctaaatttgtggtaatttgttacagcagtgatacgaaactaatacaaccactattcacatttttaaaaattacatatttttgacttgtgttttggagatccaatgtcattgtgatgtttagctgtcctttttgctttcagaaatcagctttgtggactactgtaaccaaatcaaggtcagagttggctactctctgaggctttctgtcatgaatctgctggcggcctctcagggcagagaccctgacctcgcatgtaggtaggttatctattgctgggagtgagatctgtgttgatggcatttgctgactgtagttcagttatttctggattaacttctgcttttgattacccacactatttttttgtgtggataatcctttatccaaataatcaaaaattcaatgcccaaacatgctccattttggggcacttggaatccaaaggttttgtagctctgctcctctggtagtgccttcaaagcataaatctttaatgttctcactagattggttggctaattcatgaatgttcttcattctgggtaataagagcaaatatttcctgaacactttactatgccagtcaaactctaggctgagcctgtttgatgttcattacattttgaatactcactctaagctgagcacaccatggctacccccattttacagatgagaacatgagggctggaaaggttttgtggcttgagcatgctcacacagctagtgcaaggcagagctctgctctgaagccaggcagcctgattctcaagctcacacttctacccagcaacagcactgctacactctttttggaagtggcccaagttcacttccagaaacagaggtaaagttaacatcttgctttaactggtagtggaagaggccaagagtcaggaggcagaagcaatgcctttgttgcactttctccgtggcacacgcttgtgtgacaggagggactcccagtgcgtgtgatggtcactagtttctatttctaggacattggtctcacctcctacctcacaaaaaagtgaagacaatcattctcttaatgttttgtgatcaaaatggattaaaaagggttcctgctgtgtctagtggtggtttacagagaatgtctgtgtcaacaaaatgtctgcatcaacaaaaaagaaagttcctagtcgtttctgcatttcatctccctcagtttggttgcatttcccatttgcctcacacgtcaatggtattcacctactgttcaatttgtaggatggctgggcagccttcacagagctccagaattccttcctttcagattggagggcatagtgctcacacagtggttctcaatcaggagcgattttgttcctcgggggacatttggcaatatctggagacatttttgattgtcacaactggggtaggacgcgactggtatctagtaggttgtattcgtttcctgatgttgtatgtatcaaactaccacaaacttggtggcttaaaataacagaaatttattatctcacaattctggaggccagaaatctgaaaagaagatatcagcagggttggtcccttctggagactctgagggagaatcctttctgtgcctctctcctaggtctggctggtcactcgcggtcattgacattccatggcttatagcagcagcactccagtctctgtctctgacttcacacggccttcccctctgtgtctttgcatctcaaatcatcctctcatttctctcacatggacacctgtcattggatttaggacccaccctaaatccagcataatctcatcctgaggtccttaacttgatgacgtctgcaaagacatgctatttccaaataaggttacattcacaggtactggggtttaggtcttggacgtatcttttcagaggacgctattcagtctgctacatgagtagaggccagggaggctgagatacatctgacagcacaggacagccctctcacaaagaggctgagaaactctgctcgagtgagaaatttgattgccacagagaatacctttccctgtacttcaagcccttcagccagctgtggtgtgcagtgtgacccagtgcgggcaatgcagtcagatgccagctattacctccttttttttttcaagtgtgaacaatcatttccaatgattggaggccatttgtgcccagtaggtggcattcaaataccccacataaccaagcctggtgtgcagatgacacaacaggtaagaaatgaatgcaacttgcagaagtttgtggattcagttatgtaaatctatagtttgcatctttctcttaaatgcatgttacgaacctctgatttcccaacataggccctcagggctttctccttctccagcctcctcctcaccttaatgattactctatttggatccagtgttttatgggaatttataccaggggtcctgaacttttcctgcaaagagccagatagtaaatatttcgggttttgcaggccaaaaggcaaaactgagaataccatgtgaattctgagataacgagagagaagtcctgtggctccctgccccatttgattagggtggctggtcctggatggcaggcagctttctgcccaggtgccatctactgcagactttctctaggggaaaagtgaccgccctttgaatctgaaccataggctctgggaggaagggggagggcctggatctggggaaggatcgctaccatgatctgtttcgctctctgccctggtgacattctggtgcacccttctctccttttggagaactgggccatctgaacttgggcagttgactgaagggtcctggactgcttgaagcccagcagtcgcccacagcagagacctcactgtgtaggcggtgtccagtgtgggccctgatcagtgccactggcctgggaggcaggttgtgggaacagagggggaaatagggggcagagggtgatgctctggctggtctccccactaacagtggcagcttgctccagcaaggtctgtgggccacacaaacccaggtggtgggatggatttggcccacgggccataatttgccagcctctggtttgattgtatggcagatactcaattagtccttttcagcttgagaaactgtgtataactcatttgcaaatgttgcaaatgagttgaaatgatgttgaaagcagtaagaaccatttgacacctctgtgctaagctagtccataggttttttttttttttaatttaccgattaatacgtcaaggcttagaaaaatgggcactgccaagcttctctttgcaaattaacatgcggaccaaagagatatccaggatcagggagctgaaacgaatgtttttgccctttgcatcttgaagtttagctcctctactcctccacacccccaaccatcttactggagtacacagtcctgcaaaatgcaagcaccagggatccgattctatttattcttgtgatacatagttcagttttggcaaactaatgttttgggaacagtgaccaatgaatttgtcttgtcttttatgatataatcttcaaagacaaatattagaagcagtatgtttagaaagaattagaagagcagtgaactccaacatccaaagtttcaaatgtcgtgactgtgtgctgcctatgctaactgtctggcatttgcaatatggatgctttgcttaagacaaaatgctttcctagtcaaagccccagaaaattgtctgctatcacagtattgactgctgtctgtcagcaagtattttttccttgcttagaaacttcatcaaaatgccttctcaaaaatcagctgtcacctccccttctattcagctaacctcacactgtatcctccttgggatgcacacttactaatcctcttgaagccaagttagaccaggtttgtgggacgtcagctcttgccctctccctttggaaatccctcctgatgcaatttgagctgaagacatttccagagtccttcattgtgtgcaaattccaaatgaaatagatttcaggtctgtcactctgccatggaagtaatcaatagccaccagaaacggatatttttaatgaagaaatggaaaatctaggataacaaatgagagatttgagtctaggagagggcagaaaatgagttttaggctccgaaaccatgttcctgcctcagtcaaaaatagcctttagtgatctgattggcactgacaaaagagctatctcagagggaagatgcatgcctatcttgtggctgaagatgctgaaatggctcacttgtacctccagatccagattcttgccaatgcccagacagatgggggtccctgtgtgaggaaaggagcactcagtgtgggtcctgctacctcctgaatccttttccaccttctgtggcacctgctattttgctgctgaggtttcttctgggcctatatgacatgcccgtaattttgaggtaagtgacaatgagcattgccctcctcctacccataaatatgggcttgcagggctccagccttggccttctcatctgtacaagctctgtctgctaccttagccagggtcttggttttgaccatccctccccagtctctgaccttggtctatctccagaactccagattggcttctttaacttcctgtttggatgcagctgaagatccctcaggcacttcaaactcagtgtgccatttacaagagacacactttagattcaaagccaccgaaaggttgaaagatttcatatctggaggcgatttggcatctccagggagatttggcatccccatacctgtgggatgagatggatgaggaggagtcaattatgatacttcatcttactagagctaactgggagggtagagggatgttggaaaggtagaagtggtggtggaccgtcatggaggtatgatggtgacttagaagaggaaaatggagttgtgttgataagttcttttttggttgcaaatcacaaagacttaaattagcttaaacacacacacacacacactccaaaccacccctccccccacacacacaccaaaggaaaaaaaaactttataactttgttggctcaaggaactgggaagtccaaagaagtagtttgaagaacagctggatccaggtattcaaacagtgctgtcatagactgggttcccccatcaaggaggctgagacaaaggctcgtgtgagggtagtttatttgggagcagcacgggaaagggaatgcaagagacctaagagaaggatgcaaaaatgagttggctggcaccatgggaaactggagctcaacgccatatgggatcttcaggagagccttatagaacccatctcaggactgcccttcttggtgacaaagggggaagcatttattcatcagctctgtccctcattcatcaagtgtggccccctgggtattggcacccctcatatggatgggttgcacaggtgagtgctgagccagttcaacaggtgtcttatgagagagaagctacagagtagaaaatgaactcattgcagtctcagaggagtctcagggtggaaaacattgtcaggttgcacctgcatgaggctggtcaaagcctacatggaactggtgtcagtagcagttggtggagtcagggcagaggccaagaggatttgaagtggcccataggtgtcttatccgtaaccagcaggtctctattttcttgtctcttgttccatctcttgattctgcttgcctcagcctgattcttagaaaggtatatccacatggtgacaagacatccccaagaagctccaagttatatggtccttagagttactgcagagaaagagaccttggccaccccatgcctaatgttcaaaattgatttggattgacctatcctggggtatgtgctcagtctgtgggaaagaaagggggtcttaactccttgccctgttagaattacatgaatttgagagtggagctacttcccagtggaagggtggctggtcacggcagatgtgaagatatgatgcttagatcctttctcaagcttcaagaaaaaatcttgctgctaagctttgaggagtgtatttcattcgctctattagctttagagccaaggacatgcacttcttagagcagtcgctggccaaggactgaacaagacaataaaggctctagccatttctgcccaatgtgagactcctctaagggtaatctttactctagagctccctgttgggttgatggagaagttgccaggtcaacatcacagtctggaagcttcctctgcccaattcttcctcaggtgttactctccaacatacatgttgcatttctaactccatctctgtgcgtgcttcttggagaacccagctgacacacgggcagatgaagaaataaccaatgttctctcaagggataagataacttggaagatgaagggaggaggaatgagaaaatcccaagttttgagtgggtacagcaaaaggcttccaataccctcttctttggcacttctcctcagaaccacttccaaaaatggcctatgtacagcactgaaaatggccctggaagtaaaaggcagacctggcacttgaaatctaggccttcaggttttgatatcctaccagctgcagggcttgcactgcactgttgtaagacagtgggctgcatatagacagggagataaatacagacagtacatgctctcagggcaaaccatgtgtgggcaagcctgcttctccttgcagaggcattgactctgcatagaacctcatgtagaatcacatcgattccaaaaaccactttccatacgagttgtcttctgccaacaggcacatgagggaagagaatggagctcctttgtgtgtaggttggccctgctaagttgctgaaattcaaggtctgaggaagagtcaagaaacatgttaacctagactcaaatgttctcatttctctgagactactctgtctaatgtgtctccaaacacctggtttgtgcatcattggccttgggtttacaaattggagtgagttttataggaaggtggcacataaaattataggtctataaacggccatagtaagtcatccaagtaaaaggcttaaattccaagtcatatggtatgaggaaactgagctgaaattctgttattttcactggcaggaaaacaaaaatgcacaaaattcttattattctgagtgtacaggaatcagaatgcattcccatggtgacttcttgtgccctacatgcaagggagcaaaacagaagttctagttcaccaatctgacttctaatctctgagatttgatgtgaatacaaataatggttttctgtggtaccttcagagtatgcatcactggctgtgtcataaaatttttcttgtggtcctaagggagaaatttaaggcaaacgctattaggatcatttttgtagctggacagatttaacaagcaaagggttatgcgattgctactttgtagttgaaggaattgggttctttctgtgcccattcctgttaaatcacaaatgacaacaaaggtgaatgactttagtttatgtaagttgtattgatcttggtaagatccagcattataccagcatcatcttagagaggcaggtctggaaagtgattatcaactgttcaattatgttacattcttaagcaaggtgattttttaaaaaatttatttttcattctggggtacatgtgtgggatgtacaggtttgttacataggtaaatgtgtgccatggtggtttgctgcacctatcaacccatcacctaggtattaagcccaccatgtattagctatttttcctaatgctctccctcctcactaccccaccctgcaaccggccccagtgtgtgttgttcccctccctgtgtccatgtgttctcattgttcagcccccacttgtaagtcaacatcccttcatgttaaaaactctcaataaactaggtattgaaggaaaatacctcaaaataataagagccattaatgacaaacccacagccaataacatgctgaatggacaaaagctggaagcattccccttgaaaaccggcacaagacaaggatgccctctctcaccactcctattcaacacagtattggaagttctgcccagggcaatcaggcaagagaaagaagtgtattcaaatagaaagagaggaagtcaaattttctctgtttgcagacgacatgatgctatatctagaaacccccattgtatcagcccaaaagcttgttaaactcataagcaacttcagcaaagtctcaggatacaaaatcaatgtgcagaagtcacaagcatttctatacaccaacaacaggcaagcagagaaccaaatcatgaatgtatttatttctttagaagtagaatttccccttggctgtgagagagtgcaggtgcattcagggaagaagtctttactggtgcagtcagagagatgggagttgagatgaggcagtgaactgactgttcaggcagtggaggaggtgttgctagattttgggtattcaagaacagaaatccaagttgaatgatctcatcagacatattgggctgttgggaatcgactcaagctagtcaaacacctaaaagactaagggataacacaggacacaaatgcaagcactacctgtatgtggctggggtatttgtgccaaccactctgaagctttctgtcctggtgtccaggcatccagggaatgggcttagaaatgagaagactgggtgggtagcaagaaattagaattgaggctgatggatggtcccaaggatttctcggttcaggtcatggtgactctggtaaatcatacaactctctcaatagtatttatctctaaggaataagagttttcatattagtcagattcagcacctgcctctttcctggatagacattttcccgatcttcagatagattagtatatcccgcatattaaaaatagcctttttaaaaaagaaataagtaacaccatggaatagtttataattactttccagacctacctctctaggataatgctggtgtaattctggattttaccaaggtcagggataacttcctctccttgatagtcctgactatctcattggtttttgaaagttttgggatgggcatttcaaaataccaagagataggcaaacacaagaggagtttttttttataatttattccatttttcctatgagatagtatcaagtaataatcacatatgaatgaaattgggtttttaagtcctctattggtgagatttttctttatctttcaaatgttggagctgtgggtgccattccaagatgggggtgcaggcaaatggaggtgtgccagtagccaagcttggctggcacatggctttgtttcacctggggcagaaatgatggcaattggtgatatctgttgtacataactctcatcatgggaagcactgaaggacaggctttctctctcttttctctaataacatcattaacatagcaaattataattttggaacaggggaagttttatctcagtaattttatacttctatttccagtttttttcctttctgcagcatgtcttaattatattttgggttgaaacaagagtcttgtagcaccttgtgataatgacaaaagtgtcagtttaggaatcctttctttcccagaacaaggaaaaatggacatactgttagtgacctgacctagagccccatgcctgttaatctctagattagccagtgattttccagagcaatacattgttcatggagttctggatatctcccagactcttttgtcacccatttacacacacatacacacacacacacacacgtgcacacacacacacacacacacacacacacactcctgacttcctagtttcattcatgatatgtgaatgctgcctgtttaattttctgaaagtagtcttatttcctttataaggcaaaagtgattaatattcgtcaagtttacaatatgttcccctaaatttcccagcttcctttgaagttaagaggaggtcatctgacaacttctactgaatgaattctgtgaagaaatggcatatgttatgtatgggccaaagaagtgtagaactagtgtgcctcttccatctttctttttcaaccatggcaacctgggaattcacatattgagatggcagtttcaccagatggaggaggtttggatccctgagtcaccagatggaggcaagctctggccaacttgcattggagttcatgtaagtaagaaacaaacttctgttgtgctaagcctttgagatttttgttactgcagcatagacagtcttatgctaactgaaccttatttccacattcctataaacatacagtcttctctatgaactgattacagatataaaagatttggagatctcagactcaaatatctaaagtatcagaataggctaggtggagaaacattctggccagcttcctttaggactcagactaaacaagtaagcaaaaacaaaagcaaatacaaacccaagttttctgctcaaataatctcctcttccaaactactcaggatcctagaaattatgtggtttgtcaatgcagaactgaagaacactattgcactatctcttcaggaatgttaagttatttacaagatgggtcagagttggcctgaaggtgttaaagagtgtccttggtggggtagggatggagggctctatggaaaattgtgcattctccacagttttctatattcctgtcctttaccttctggcattcgttctataggtaatgggctagacttgattatctgataggcagactatgcacacacacacacacacacacacacacacacacacaaatcattctggggggaattaaatattttgaaaaaacaaaccaacagtcatgagaaaaatcaggactttgtcggacttccttatattttggggatagggctcagtattagttttatttaggctgacattaagaaagggggttagatgtggatgaaatttctgtaatatctttcagagcttaagggctctaaagctcttcataggagcctgctcagatatttcttcagagttgtatcttctatccaattcttctcaaatggctgataataagcattaaatacaaattaagcattgtttagaaataacagagggtgtttacgttttagaaaggtagggatgggttggtaagagtttgcggcagagtctaactagttgattaccaaactgattttctttttttctgggacatacaacttgactacatttcccagaattccttacagttaagtagagaatgcgttgtacaccatctccaggcctggtccatcaatagtctccatgtgattctctatatctttctctttccttgagggatgacctaatgcagagcatctagtggaggaggccccagggatttagagccatgtagatgggagggagcctgggtctttgaatgattgtgtggaccagagtctacctgatagcctgcattaaactgatatgtatgagaaaaaagctactgagagttgggagttgtttgctgcagtggttaagctaccctgactaatacagacctcttagctaatcatagtttattctttcctaagaaatgtgcactgtatgaagcagttttttaggtgccctaaacacctctgctaaagctccagggtttgagggttactacggagggttatctgtggagaattttcagatgcgtccttccaaaagtggtattgattattcctctttcctgacaacatggtaacaaatttttacctctcctatgtaacctgtcacacaatatttaaattattgttaatggtgtaacttgacaaccttatgcaaaaagggggatttatttcatactaggaagtggtctccaaagatggccgccaccaattcctgtcttccatgtatgtgcatgtgtctccaccaaccaaggaacagagtctatttcctctcccctggaatctagactggcctaatgacttgctttgaccaacagaatatggagaatatgacattctgggacttctgagcacaagccttaagtggagtggctgctttgacagcatccctctacaagacagctgacatttaagaattctgactatcctgagactaccacattgtgagaaagcccaaaccaaccacgtggagtgcccacgtggggaagcacttagacaccagatgtgagtacagtcttctcttttttttttttttttttttttgagacagagtctcgctccattgcccaggctggagtgcagtggtgtaatcttggctcactgtaacctccatctcccgcgtttaagcaattctctggcctcagcctcctgagtagctgggattacaggcgtgtgctaccatgcccagctaatttttgtatttttagtagagacagggtttcaccatgttggccaggctagtctccaaactcctgacctcaaatgatccacccacttcggcctcccaaagtgctgggattacaggcatgagccacctgaatgaagtgagcagccatgagtgaagcttttttgaaccttctcacccagcccagacaccagctgaatgcagctgagtgcgtggctctagtcaaggcaaaatagatcaaaagaaccatccagctgagtcaacttacagaatcatgagaaaaataaattgttgctagtttaagccactacattttggagtggttatacagcaacagataactgaaacaggagggattctaggtgtgaggttttgattgattaggaaaagaattgtagtttcccttgggattattcattgttgtcttttaagtcatgaaggcagaaacgtggctttcaaagaggtctgagaaggccattgtgcttggatgactgcagtggccaccttcccatgcttatgcttggcctgggtgaatatttgttcaacaaaagttttattattattatttttagatggtgtcttggtctgttgcccaggctagagtgcaatggcacaatctcagctcactgcaacctccgtctcccaggttcaagcaattctcctgcctcagcctcctgagtagctgggactacaggcacatgccaccacgcccagctaatttttgtatttttagtagagatggcatttcgccatgttggccaggctgatccaacaaaagttttttgagtgaaagtgattattcatttacctctcattttctatcttagtaggggaatgatcatatgttgcctgggcacagaacagtgcctcaataagggagcaggctttaaaggtttattgactaagttaatgctgggtatggtgggggagacctcatcctttgagggaatgagtaagtcatgaggagccctcagcttaccccaaatgtctcacctaaaggtcacctaaatgtctcacctaaaggaagtggctagatgaagaaagctttggtgcacctcaagagttgcagtaaatcaataaatataccactatgcaatgcaaaagggaattcagttgccactcaatagaaagagaaagaaattccttatcattagaccagaaaccattatctgaggataaagatcaatcaaattgcatttgaaacactctttgtgttgctcttagaaagtgttcttttcttgagaaatgatttagcactcagtatcgacaacatgataacccctgagaacaaatagcagagatggctctgtactaggaaaagcaaatgtgaaatggagcgtacctggacagaaataaacccagtggagacaaaatatgcaagggctgttacttatctgttttggcccacattctgggtatagctattttgatttcattagccaggtagaggtaattcgtgtatcaatttatgacatagccagaggagttctttaacttggaactttgtgaaaataaaaggatcagctgacaagagatgaatcatgctttggaaagagaactatatccatttaaatattaagttgaataaatctttaccacaaactttaaagaatatactgcagggttctgttacaacttccagttactcctttttaagtagctgataagaatttttagtttgtttgaccaagggacccacggtgttgaattcaggatttgcttatccatccagccattcactcatctcctgtctatctgtttatccatttgtccatttatatgaacatttgctattttcctggtgctgtgtgtgctgtgccattggtgatattaacaagctggtaatacagagtgtgacaaatggttttcatgtgggagcccactgtaacatcactttgctactcttctgactgaactccaaactgtttttgacccattccatttcataccaagcatggaaactttcttgtttgaagacccagtctatcatttgtagaatcgtattggttttttgtttgtttgttttgcttttacaattgaccaaagtttgcttgaaacataaaacctttaacactgtgttgttaagggtgtttgatacctctgatatgctcaaatactggaagcttgtttcgctccttaatttgatataacctgatgttaaacgagacatttcttgtttcccatttcaactgaggcctcaacacttgagaatacgtcgcaagtctccacgttctagggagaggggttggggttagaccatctgtgctgtcgtaaagaaatacctgagactgggtaatttataaagaaaagagatttaattggctcacagttctgtaggctgtacagaaagcatgacaccggcatctgctgggcttctgatgaggcctcagggtacttttactcatcatgtgttacgtggcatttgaggaaacaagaaagagaggaggaggagccagcctcccttaaacaaccaactctcatgtgaactaactcagcgagaactcactcataaccaaggggatggcactaagctattcatgagggacccaaccccatgacccaaacacctcctacgaagccccacctcgaacattagagattcggaggaaacaagcatctaaaacatatcaggggtagatcatgtatgtaggataaggtaagagattatatttgtccaggggcctttagcctatcactcacctcaaaggtgtgtgaggtcagctgagggttgattgaagaaactcgaggctgtatgggaagtgtcggtagaaacacattatccagttatagccatgggaccagaggagagcttagagtgaaagtccatagaaaatctggccaaatgaccctcagagtttggaggacacagagactactggctgacacctgcctggacatgcctaaagtctgaaggttggcaacttctgtgaggacaaagaggagagagagagggttgccataggggcggcttgaggtttgaacgttcatcctggcaaagaggccgacttccaaggggtatactgggtactcaaggagggacccctctcaagaatactgcttgcggcccggtgcggtggctcatgcctgtaaccctagcactttgggaggccgaggcgggcggatcactggaggtcaggagtttgagaccagcctggccaacatggtgaaaccccgtctccactaaaaatacgaaaattagctgggcatggtggggcacgcctctgtagtcccagctactactcaggaggctgaggcaggagaatcacttgaacccaggaggcagaggttgcagtgagccaagactgcaccactgcactccagcctgggcaaccgagtgagactccatcttaaaaaaaaaaaaaaatactgcttactgcttgcctgggagagatggtccaggtagaaggaacctgcaaggggcaataaccaggagtacaggtgacaagtggcctctggagactgcattcttgaagcagaggagagagaagtgggaagttcccaaaggagggtgggtgttatggtctgaatgtgtcccccacaatttatatgttgaaacttagtcaccaatgcaatagtattaagaggtgggaactttaggaggtgattaagttatgagggtgaagacctcacagatgagattagcaccttataaaagagtttgaggggatcagtctgttccttctgtccctttggccacatgacgacaagattcatcccgtctgtaggaagcaacgtttaaggtgccatctggcaagcagagaccagaccctcaccgaacaccaaacctgctggcaccttgattttggacttttcagtctccagaactgtaagaaatacatttctgttctttaccaatgatccagtctcaggtattttgttatagcagcctgaatgaactaagacaatgggccactgaaaaacacaacaaagcattctgcaagagagagtcagcttttgtgcatctgtgacaccaccagattacaagcacagagtcaagtaaggccttttcccccttcagctctgctcctagccactttggagtagccagaggcagcataatgagtaggggactaggagtagaagaataaagtggaattagaggaggatagttttgcttttaggctatactgggctcctggatctgcagattcactggtggaaacacataaagttgtttctcagcttggaccctaccaaatgcagctcattcaatatattgggcacatcagggatggtttttatgatcctattactctttgtcttaatttgagtgctctgctagcctctgtctgctggcttctttgctgcaattggtatttaatgtgcagtaggaataggagatgtatgtaaagttcctttcattggagagagtgggctgaattctgtgttagaaatggattttaactattgggtgtcatgacatatcctctggcatccttcagtatcctttcctgagcaagataggtgacaggttgctttcctttagccatttcatggccaacatttaggaggcttcatggcctttaagaaaggccaggatatctgatatcttagaaatgaaaagattgagaggaaactggattatgtgtggaatctcatagtggaaaccaaggcaataatgataaagactcaagctaaggttgtcgcagggtggaaaaataattggggatggatttggggaggcagcctcccatttcacttagtgccagtactacccatctcctgaccacgtctctgtccttggaaccatcctgaacgattaatacttccatataacttcatattctattgtgtcaaaaagatttgatttacacctgaaatgcatctcaaatcttcctccttatttctagtttccactgtttctgatgaacttcactactgtttgcccttcctttccaaatagtttcctaactgggcactctgcttcctgcttctttcttcaggccacactctgcattggagctaatccttctaagaatctttctaaaacatcagagctgaagattgtggcctgagcaaaagtatttgtgcccactgtgttaggcagaatgtctcccttcccccatacctatgccttaatccctgaaacctgtgagtatgttacattacatgccaaaaggaactttgcagacataattaatgttatggaccttaaactagggagagtattctgtattatccaggtgggtccaatctaatcatgagtccttaaaagcagacaactttcctaggctagatagaggtggggagatgtggcagaagaagaaattggagagattcaaagcttaagagagacttaactcagggttgtaggagaaggaaagcactagaaggaatgtgggcaacagttaaaacaggaccccgagccaacagcccacaaggaaatgaggacctttgttctacacccataaggaccttaacttggccaacaacctgaataagctcagaagcagattcatcctcagagccttcagaaaggaatgcagccctgccacaccttggctttggtcttgtgagaccctaagctgaagacctgttgggctacattgtgccaaagcctctgacatgcagaactataagctaataaatacttggaattataagccactaaatttgtggctatttgttacagcagcaatagaaagctaatacacctactcatctcaaccaaaggggataaacagagaaggattgggaggttggggggtgcttatcaaaggaggaactatttcaacaaatatctgggagctctaaagcagaacatgcaaagccagttggcagacgaaagagaacagaggtgctacatcccagactctcctgtgaaagttgcaatggaggtgggagtcaaattgtgtctcacaaatctgaagcgacttttgggctcaagcatgcaggtaaaagagtgggagcaagaagtgaggttcaaataaaggggactcactgaagcagaacctctcaccttcacttggccgaagcagcctggttagtacttacatccgggtgcaacaatgaaaattctctaaagaaagtgagctcaccatctcacagtatctatggctcatccagcgggtgttcatgccatgatcattacaaggggcatcacaagtggggtccagcaggcagcggagagtgtaattgggcaaaatgttcatcttccagagtagggtgtcaatatctatcccgtctagttgataagacaacagaggatgagcttgtcctcatttccctccagcccttaaacccccaccggaaccctagcccaggagcttagtgctgttctcagttggaatgtcacctttctgacatttttcgatgagctattatttagagttttggtgagaaatcacagaacaactaaaaacaagagattgcttccaggggcaagactgaggcgggggcaggtagcagcagggctaaagacactgcttttcatttcataagtccttctcactatttgacttttcatcgtttaaaattattacattgatgaaaaagatcaagttaccacagagcttgtctgtatcattttcgttttaaaaatcccacagtccttaccaccaaacctgggagcttcagtctcatgggtctgttaccttggtgcagaatgatttttctgttttctttgcttaggaaaaccagatggagttcttatagaccaggtcaactgtcatcacccctatgaagctctccatgacccttggcacttaattagacttggtcacgtagtacagtttccacatttgcatgtacatttccattgctattctgtgagtttcttgaaatatatggcagtgtctatttcatagttgaatccccattctctgacacagtgttgagtgttaggagaggcacaataatcctttgcaaacaagtagttgaatattgccctttgtgacttttcctatcttattttattttaatcacaattttacctctgtctgatcctgacatttaagctctggtgtctcttgatctgagggggctttgaagttcattttaaccagatttcgcctgaggaaatatatttcagcaatggaggacttcgttatcccacgtgacttgccccaggcccctaatccctctggagatagtactagttcttcatgaacacaaacaaggaattttaatgcacattcgaccggaaggctttatcaacctttgtccttttacttgccaaaataacagagcatttactgtaggaaataaaattttaaaagcttgcaaaattaaaaaatagattatgacttgtgctaaagtcttcatttccatataagatcaaaaattaataaatgcacatattcaatttttcattcttctacctcacaaaagtgttgaggcagcctgcaagaaatcggaactatctctgagacattatgatgaccagtgtgaaagaacaaggacttagcaatagagaatcatccaccacaagctttattccagttgtatgttctcattgtgcatttaaaatgtgcctccatattcaaaaaattaattcacttctaatttttctggactctacttattgcataaagtgagacacacctgtagacaataaaaagggaaacagactctctttgctgaccaggcaatcaaaaacgtgttcagtggaaaccacaagaaagaaaaaacctgcttactttctgggtgggaaaataatgagtcatatacttgtgataaatagaattatcaattcataaattccaagtaataggttttcacttgtcagggacgaatgacccattcttttgcttatgggaaatagcactacccagttcctagtatgtgcagctgccaccttagatgttggcatctgctggtctttgaccacgtctaatgaatgagttctgcttattttgatgctgcatccaaacggaaggaatagtaacaccttataccaacagctgtggaggttgatgtcttctttttcaagggaggaatgggctctaaatacattctcttttttggcaaaatttgttcatgataagccgccagtagcctgataacagactgcctgaccttctcaaaatagaaaaggtcatcacagcctgggtatcccaaagctgagctaggcacagcctttcacaattagaaaggtaggtctttttctctctccattctctctgtaggatatgcaccatgtcccaggtcactgtttgaggcctcagcttcagagatgaaaatacttagtggtgttgggtccactgattactcatccaaggagtttatttcggcccttagaatacatgaaagtttgtcatacaaactttctttgcctatattttccataggaaatgaatgatcaaacagacaaatgtgatatcataaaattcatgcaccttaaaaaaagaaacctatgtacatagattcttagctaatacttgttataagtaactttctttgtgcctatataacctataagctcattctttcagtcactctttctgtgttgattaatgttttcagctcatgaaccatgtgcatttcccctacctcctgtttcctgtatattgacatccccatacagatattggacatgctagctccaagtttcatctccagcctggaacttccattacagtaaatcctcacttagcattgtcgataggttcttggaaagtgcaactttacctgaaatgacatacaacagcaggtccttgactaacgtcgttttcttcaatgttgtttagttataacattgatgagaaaaaaaattggtttcattatactaacctggtgtgggaattggtatgctagctatgtcttttagacaaacatagacctggaaagtctttatctagaaggctggacaggactttaagtgtgaaatctagagaggtgatggataggagcgaactggcaggagaccagagttctaattcttactctagtaattgctaaatttgtgaccttggacaattgacttaaaactatctagcctctacttcttcctccataaaggaaaaggattggctcagtgttcccaacgagcccatcagttctatgattctggtctctagacctgcacttatctgtagtcacctaaactagagggtctaattctctggaactttgcagttgtgactcatggttaccgcctctgtttttgtttgtttgttttgttttgtcttttgagacagggtctcactctgttgcccaggctggagtgcagtggtgtgatcatggctcactgcatcctcaacttcctgggctcgggtgatcttcccacctcatcctctcaagtagctgggactataggcatgcaccactatgccaagctaattttttgtatttttaaaaaatagaaacggggttttgccatgtttcccaggctggcctcaaagttttgggcttaaggaatcctcctgccttggcctcccaaggtgttgagattacagatgtgagccaccgcatcaggcttgttgctgcctcatatttatttcacaaaattagtcattcctaatgaacttcagatttgtgccaaatctctatcccatctctatttttattttctaaatacttttcttctaattgactcattttttaaagcttaatattgaatcatttcattacaataaagggatacatgggttagtatttatggtagcagaaataactatagtggggaaaaaaaaaaaaacctaacaattacccaggggcagtaacccagaattattgctgcaaaggctcagacaagtagaccctctagtctgggtgatcacttgttaatgcaaatccagaaaccatttcagcaacactgtccttcaaaaattaaggagaaatagaaatattttcagatgaactgtgagaattcattgatagctggcctaaactacaagaaatgataataggagttctttacactgaagggaaatgacactagattacaacttggatctttaagaaagaatgaagatcagttcccagtgtgttagctgatgttgcagctatttcttttagacagatatagggctagaatgtggcacagggggcaatgtctgggacactatgatgttgtgtaaggcagtcagcagctatattgaggtgcttttctacaatgttgatttttcccagagaccatatctagaacagcaacctaaatgcaacctaaactagagtcgccatccaattttccatgtctatctgtcttttacccatcacaatgcagagtttagtggagatggataggaattcccatcctgcatctttaagtctccaatggtgcttccaatcagtacgattgccctgggctagtggtgttggtcataattgcctttcttgctatggagggaggactctggaatcttcttccacttcccttcctaccataggttgggagcaaagttggcattttgcctgttgccgagcatacactcaggatttgggataattaagctcagggtgggcttggggttccactgagcttgccattatgttggcacagatcaaattctgtttaacttcttatccccattaagccccacctctgactaatgggcaacagaaacactctggttacctagaaatcacttttggctcagcatccagaaggggttcaaatgctggccaccaaaggaaaaatatcccaaacatctgctgctttccttagtattacattctcatttatctcttcaatgattattttccttgtcaggtatttaggtcttaccccctactctgagagctcttcatgagaatacccatgtactttttgaatatattgtgtaaccctggatcagacttttacagaagccccacacatacctacgatcgaagctgcatagagagttgaggtttcatctgatgattcaaatccaatgccactacatttgaccattattctaagtgaagtaactcaggaatggaaaactaaacatcatgtattctcacttatcagtgggagctaagctatgaggacgcaaaggcataagaatgatacaatggactttggagactcagaggaaagggtgggaaagggtgagggataaaagactacacattggacacagtaaacactgctggggtgatgggtgcaccaaaatctcagaaatcaccagtaaagaacttattcatgtaaccaaacaccacctgttcccccaaaaacctattgaaatttttaaaatccttaaaaaatccaatgcttccacctttacaaagttgggtgatatgaatagtattttacattgttgtagcaggaacccaaaccacccctgggatgatgtctatctactcagagttctctaaaatgaacttttgctgacaacccatctcctgggtgaaacgtaaaaagaatacaatgactgttcccattgtcttttggtggcatttataaagcccccacctgtgggagcttagtactaaatgtcatacaaagcaatgtcaaaaggcacagaccctattctctaagggttataattgaaaacggacctctgcattgaccctgttggccgtgctagatgctgcctccaaaaagtttctctctggtccatgactcttagtggtaatgccatttacacatgggaaggaaccagtctttcttcttccacaaagccctgagcttctgtgattttagccccagcaaaaagatctctagaggaataggctggtggatgacacaccctgaatctgttcaccctgaccgagttgcttcttccctctgggattctcttacctgatttctatacccactaccatcctgctttccgtggaaaaaaaaaatgctagctcgctgtggacatccgtcccttccttggttctgattgacagagatgagaaaggctttactttgaatatatttaattgtaataaagaaataaaataagagaaaaaccagaattgcaattcagaaagacttgactaactcccaaagagctaaaattatgtgaagacaaaaatacatgtatgataacaacacagcttagcaagactagctaactcctgtataaccattgccttccataccttgtcttttgttatccataacaagctcctttcaatcatacctgagtttatactaatgagatgacttatagggcaggagggctaaacagctttgggatgaggctagttgacagaaaagctaaccacatgactagagagttagaactctctgctgcatccccaacccctggttggggaagaggatctggagattcaattcaatcaccaatagccaatgagtgtgtcaatagtgcttacatgaaacctcagtaaaaactggacaatgaggtttgggggaacttcctggtcggtgaatatatcaatgtactgggagggtggcatgcctcatctttctgggaacagaggcttctgtgctcagggtccttccagacctcgctctatatacctctttacctggctgtttgtaccttttataataaactgttgtaactatagcactttcctgagttgtgtgagtcatcttagcgaattgtcaaacccacatggggagcaagtcatgggaactcctgaatttgtaattggctgggcagaagtgcagggagcctggtgaccccatttgtggctagcatctgaagtgagagcagtcatgtgggactgagctctttacctgtggggtctgtgctaactccggatagttaatgtctccattgaattaaatggtgggaaacccagttagtgctggagaattgattgttgtaaaaatgacatagtggttgacaggaccattgggacgttcaaaatgaaatctttttcttttggtgaaagcctaactgtggttactcatacaccaaaggtatagcaagcctttaacaaagatcgtcaaactggatggaacacttagaaaactgtaggatattgactgggtgcagtggctcatgcctgtaatcttagcactttgggaggcagagttgggtgaatcgcttgagctcaggagttcaagaacagcctgggcagcatggcaaaaccccggctcaaaaaaaaaaaattagcttggcgcggtggcacgtgcctgtagtcccacttcagctacttgggagctactgtagtcctcagcctcagctactcatgagactgaagtgggaggatcgcttgagtctgggaggtcgaagttgcactgagccatgactgtgccactgtactcaggcctgggtgacagagtgagaccctgtctcaaaagagaaaaaaggggaagcttgtaggatattgatagagtatcattatgtcattgaattcgatgcataattgtacatacatagacagaaacattagttcttctgatttcacagatgaaccaattgttgcaacaacggattaaaattgattaattccctggtggggtacatcctgtaaatctatcacaaaaaggttctgtggcaaaataatattccgttttccttaaaatatcttaaatattcagacaaattggtaagcatggccacttttgaatgtggcagtgttgttatagaaataaaagaaatagttgtgggtggcgggggagaaaggtacccttccctttggtgggtgttctctgagggagaacatcttcaggcccagtggactgtggtctgcatgtaacctgcagcatgtagcacatctcaatgagatacaagtttctaacacgggactctatcaggggctggttttggcccctgtggtctggggactcttgactgagataagaaggctgctattatttctggtgtattggtttcctaccactgctgtaacagatcaccacaaacttagtggcatgaaacaacacaaatccattatcttatagttttggaggtcagaagtctgaaaatgggactaaacaggactaaaagcaaggcgtcggcagaactggttccttctggaggctgtagaggacaatctctttattgtcttttccagcttccttggctcatggccctcttctagccagaaaaggcattgctccaaagtctccatcatcacatctcctcttactctcctgctctgctttcctggtataaggacccttgtgattatattgggtcacccagataataaggataatttccacatctcaagatccttaagtaagtcacatctgtaatcccatttgccatctgtattagtcaggggtttctagggaaacagaattagtagagagagagagagagagagagagagagagagagtgtgtgtgtgtgtatgtgtgtgtgtgtgtgtgtgtgtgtatgaagatttatatattacatatgtatatgtattatattggctcatgaaattatggagattgagaagtcccatgatgtgctatctgcaagttggagaaccaggaaagctggtggtgtaactcggcccaagtccaaaggtctgagaaccaggagctctaatgtccaagggcaggagaaaatggaccagagttccatcatgaactctcatccatcacgaactctcatccatcacatagtacccagttcaagatgagagtgaaagaatttgccctttctccacctttttgttcaatttgggccctcaacagggtattccttccttcttttccttcctttattcccctcacttccctccttccttttctcctcctcctcctttctctcttttcctcatcttttttcttcccttctttccttccttctcttgtcttttctccctccctccctccttccctccttccttttcataaacattcagtgagtgcccttaaaagtcttcagtccagccatcccaaatcagtgcaaatattttagaatagttaactcttcaagctggggcaatgaaaagtcaggcaaagtcagtgttgtcaactttacccttttgtaacatgaccaagtggcaggggatgagctgggctaagaatctgacatcctgaaagagtacttatccctccacccacagctctttgtctttgaacctttactcacctctttctgtactggttagaatgggatagtaatattattttttagggtggttgttagggaacaatgtaaaattcttagtaaaagatgctgttgttttttgcctcaggcaaaatctaaccaagacctccccttaaacattgagaagacagagtaaagagtaaaagtgactataagggggtaagagtggctttattttgtcattatacttgaccccctggaagtaccaagatggcctggcatgaagaggtactagcactgccaggccctttctagcaattacaggcctggtgtttgtgagctccaactggccccacacagatggctgcttggcatctgctgtgaatgtgcacacaggcttttagtgacacaccctgttcgatctgtgtttggaatatgatttctgtcgccagtctgtctgcttggaactatgtgactttatgaaaagcaaaatgaaaactcccattgcttgaaaaatcaccacccagaaatggctttttttttctgacagattagctagaaaaaggtttggtattaaagagaaataatatgaataggaccgttggaccctgtaatatcagtggccgccattctcaatagcagtgacatttgaggaggctctgctgtttgatcttttttcttccagcttatattgacttttaaagtccaccctacatctgaaaatgccaatggcaagaaaatgtgacattaacctgaaggttataaaattgaaagcagttcattaaaaaaaaatggggggggggatgcatttcttgtgttttcttgagattgtcttctggaaagatgaagtttagatattgtatagaggtgtgcaaagcacttatggatttcaggtgaaggaaatagtcaagttgattaataaccctgcctcatgagtggcaaaaaggcaagctgtatatatcatccgagtcacctgtttaattgctttctaagtggggggtggggcttgttaaaaatgtagatctaggtctctgtccttgagggttacaactcagtgggcctgggattgggcttgggaaattgtatttttaaagctccctggtggttctgtagtttagctagatttaatacatactagaccacacaaggacatgtgatcccctgggacaaagctaaatatttttggccaaatatcactgattggcagttaaactggatcaagaaggcagtgagtttttggagaaaagttagtgattccagagaaaagaaagcagctagcaattcttgaatacttattatgggtcagttactgttctaagtgctttacagagattaatcctcagcatttatttacttgtttgtttacttatttctagcaaataaggaaaccgatacttacaaagcttctacaacttgccagagtcacagtgacaagtgttggaatgatggtttgaccccaagtgtgtataactccacagttcaaagtccaagggaaaaagaaagaagttgctcccctcccaaaagatatacaattttgctttggaaggagttagatttatttacacaaaacttctgcaagggactgacaaaaggacataaaattagtttgagttgccattaaaattcttattatgtttgggaggatgaatcttcttatctgtggtccagacaaagaagcttacttgtagggaaaaattataatcagatattaaacatctgtgtgattgattttgtttggttgacaccaaaggccagtgtatttatttatttgggtatagctttaaatgtaataaattgatgttttaaatataatactagctgtataattttattttgctttgttagcttatgctagcccaataaaatctgacaattgaacaaaagactctccttggggtgatagtttcattgtcataaaaatgtcatatagattaaggggccagctgagcccttatagtttctcagagactagagaaatcattaagaaatgcatatattatttccaaggtaaaatactggccgagtcctgccgtaatgttttttttaatgtgaatttgccaaacataaagccatgaattttcctaattctcagaaatcatcttccaaaaggcctacatgtggctgctttgcctcctagattctatcccagcagaaagcacctccctccatggatgtacttcttctgggcaagtccttgtcatggttccagctccctccaggctgccccagctcctgggctctggctgtaccacctcctttgatcctccagtcctaaagaaggaatgactttctactaaagctcagaccttgtcgtagtctgttttgcatggctataaaggaatacccgaggctgggtaatttataaagaggtttatttggctcacagatctgcaggcagttctgcaagaagtggcgacagcatcagcttctggtaaggacctcaggaagcttccattcatggcagaagaggaaggggagcaggcatcacatggtgagacaggaggaaagagtgaggggggaggtaggtgccaggctccttttagcaaccagatcttggaggaactaatagagcaagaactcactcatcaccatgaggacagcaccaagccattcatgagggatccgctcccatgacccccaataacttccaccaggccccacctctaacattgaggatcaaatttcaacatgagatttggatgggacaaacatccaaaccatatcagacccattccccaaccttccttgctctgctctgacccctacagactacatttctcaggctcccctgcccactggcttccagttagtttcaaccaatgggaaaccaggttagacactggagggtgggagaaatgccagggtaattctcttctttcttctgcttcagtttcttgtgttcttttgactttactatggtagagatatccccaaataccagttgcctctgcaggatgttccctgatttgctttcttgtcctcctccttcctttaatttccaaaatcttgaaagagctaatgtttgactgtttttccttccttaccagccacactgctagataatactcttattgaatgtgtactgagcagaattctcaccaacctccttgtcacccaactctaggatatttcctcagatttccaaagtgtcccacaatgtcaactatcttctccttcctaaaatttctcctttcgtttctcctgattctcctgtatctgtgataattcctctatgggagtggctcttcatttactgcttcaggttgtctctggagcactgaacacttctctaagcattctgcaatgcagaatgcatctcacactcgttttctttaaaactgagtctactggctcatgaggacagctaattggtctaacttagtctctgctgaaacccagcaccagatagagaaggcattcagtaaatattttgttgaatgaattaatgaaatggttatatatgcataagattatgagaatgttcatgcagtaataaatatacagtgcttagcaaaaagacaggtgcccatggaatgtacacctttgagaatttttaagttaaaatctaatgacttgaatgtttgtggtttcattaacatttagaacattaaaaattttaatatattgttaaacgtttcccatttatgatgtgcttaattacttgtgtaaaaagatttaaacttaacaggctctttgcaaattctgccttccttccaataacttacttttcgtttctaacatctgctcccagtgacctagtctctcatcacgggtctgctagccttttcttcaccacctggctccaactgtccgtctctttatatggcttctagtcaaatacttgcttatgtcctggcactctcagacatacacgtgtgcacctacatttcagactcatagccttctgttcagaagccatgcatatggcaggcagatatccttttcatcaggatcaggttcaatgccattgttgcataaagttcactggatgatgccctggtttcctggtcactgatatcggcctctccattttaatgaaatcacgttcagccaagttagaattctctttagcagttggggccaaggggaatcagaataaagaaaatgctcaggtaattcttcaactcctataccttaagcagtagaataaatgccttcactaaattcttagcttattaagtgcctggagtaacaatttgcattgtgtttctcaataataatcacaaacatcataataactgataatgtttattctggacatcctggggcaagccctcccttgacatagccctgtgagggagaaaaaaaggaaaaactggctgtattcctcctcctactctctcttttcttggcttttggcattccattttttaaaataattttcagttttatagcttttcattttggaatagtttaaaacttacacgaagttgcaaaaatagtgcagagagttcctgtgtacccttcactcaactttccacaattataatatcttacataaagatagtgcattgacaagaccaggaaattaacactggtactaataatgcattcgtgtgtgtgtgtgtgtgtgtgtgtgtgtgtgtgtgtgtgtgtgtgtgtatttctatgaaatttcatcccgtgtagattcgagtgaccatcacaatcagaatacacaacagaattgttggaacagaattgttccatcaccacaaggaaactccttcatgttaccctttaatagtcacactctccttgcaactctaactctttgccactgccgatctgttctccctcactataattttgtatataacaacttcaaggtggttatataagtggaatcatgtatgtgaccttttgtgattagcttttacactcagcatacccttgagatctatccaagttgtgtgcatcaatagtttgttacatttttcatcctttattaaaagagactttcttgaagagtgccctaactgcagtgttctgatttcagccaattgttgctcatttcttcaacatgtaatgaatgggtagagtcctgtttatgcaaggtcagctatggggcaacatggaatctaggaggcttgtctttgtaaaaactttctggttttggtcaacctttcacttttcacccaaagtgtatagtctcccttcagcacctcaccttttcttacccttggtttcctgctatctcgctatctcttagcccctgagattagaatccgtgataaggacttaggtgcaggttttttgagaggtgactgcaggaagcaggagtgagagaggagggagaaggaggaaacgagggtggataaactaatagagagtacattaattagggggttacagctgtgcaaaactggggcttggttccaccagggactcagaaggaaccgtatagaacatgtttcagaattgctgctctggagcatgggagggggaggcatgtacttactaactcccatcccttcttagttaaaggttgttccaagcacattgacctttggcacttctaggcagtgcccgcacagtgacctcctggttttacagagaaaacttggagcaaaccaaatggagagacctagtgtgaggctgagatgagagcccagcagtatgcttgggagctggccaccaccaagtcacaaaagtcagatcagggctgaggaaatgtatccaatgtccttggatggcaagagctctcactatctgacaagtcaactcctttgctttgtgtgaaggtaactggtcctgatttccacattcttggacagccagcccaggatctctcaagaggttctctttttgcttacacagttaactgactctcctgctttctagagttgttcatgcaacttacattgtcaggtgaacgtgataaccactacactacggaaaccatgcaacttactttgaaggcttatacttatttgaatgaattttatctatgtaattaaattaatccagatctgtttttaaccctgagtaacttcaaataatttaaataattatatatttttaaaacaagttcagtccttagaattctgaatcactcctttctcactcgagaactccaagttctactccttagactctagctcattcttctgcattctaagagggatccctgtactgatcccaatgtcttacccaagttcccaaactcttattttactacaagattctttcagctttttgcatatgctaccttgtgttacttcttatggtttatgtgtttatctgcctcctccattaacctccgtgatgtcagccttggagttttaatctctttgtatcctggtctactagcacagaactcgacatatagttagggtcaataaatgtttgcagctgatgttggagatggtggcagcagttcaactgtacaggaggtttcccgcttagcccttcagggatataagagtgggtcctaatttcgttctggtggagcagttttaggcggggctgctgcctggcaatgtgagatgtaggagattacaatcagtcatgcccatgtgtccagcctggcttgcctctggtggctgggaagctgggtcatgtggctttggggacaaatgtcgtgtcagtgaaagggaggcagaatgatatatagaaaagagcaggggtatggaagccaattttgatcttagataagtgactttatggaagttgcattagcagtcttacactgggaaaacctaactagctcacggggttggtgtgaggcaggaatgactaaggagagaaaggcatgtcctgttgtagccaggggtccttgcttctcgtaggcttcgtttgtggccctgttgataggcatcttctagacatccacctggccatctggctattatgctttccatgtttgtttctttttataaaaatgttattaaaaatggactagcccactgtttcagtaatctcttgctgtgtaacacactagcccaaaccttagaaccttgaaacagtaacaatttattatttctcaccatttcatgggtcaggaatttgggcagggctcagatggatggcccttctgttccatgtgtatcagctagggtcatttatttggttgtatcacctggcggtggcctgggccagaacatccaagaaaggtttgcttatattttgggggccacagtcttcctccactaggtcagttagtctctctctctctccatctgtctctctttctcctttaatttctttgtctccatataggtagtttggttttccttgaaacatggtgtaaggggtttggctctttctaatctgggcagtgagacttctaacatggtggcttattttcaggagaaaggtggaaatgaaaactgtcggtattaagtcctgggctcagaagtcccacaacgtgtcttccaccacatgccaaaacaaagcacaagtccagcccagattcgagggaaggggaaatagactcatctctcactgggaggtgtggcaggcacatctggggtgggaagaaccattgggagccctctctggagactagttagcccatgcatctaattagtccagttagcagtggtgggcttgactcaacagagggtgacaccagactgtccagggaactgcagtgtggcctggcttcacagagctacctgccattttctggagaattttgagtcaaaaacagagagagagagagaaagggagaaagagatagaacaaagctgaaaaagagaggatttgtgagggagagtaggagccaagagaagccacaagcaagatggaggcatggggccacagacatgcagggaaagggggagattctgggagagatagatcatgatgcatgtgagagaggcagagagagagttctagtccctaaaactgactggaggctttcagattccagggttaattccaatcagcccatgtgtattatacccctttttacttgagataaccaagtatatttcttttctttatttcagacaaagtgattcaacaaatgaatttcgcagtaccacatctgccacctcctgatttgtggtaggttacttctgtggttcaattttcctatctgcaaatgagaataattttacctatgtcatatggttgttttgagtattaaatgacttctattacgaggattaatatatgtgcaagcccctggaacaatgcctggcatgtggtaaacactatattagtaatttgttaaataaaaaataaggtaatgtttagaagtcttgggttgagagaacatatgaagattctgctttggaaagcaaataaaagtttataggggaaaatacatgattttcttctgcagtcaaggtaaatcagtcctaccatgctgttattgagtgtcactgaactaaaaacatgcatcctgaaaaatctggagccaaggtgtctaccagggtagacgaaactatggacatagtaaatcacagagactgaggagtcttgatccttatcaggaatgcagagcttctttgagcttgctatgctctttttccatcctttttcttcttgctcctttctccccttcccaagataacccaatttatagaattgcctcaatatgtgccggttgacatgacattctgagtggtggagagtgccagagagacccagttgtaacctgttgatttatggtcagcccgctccactgttactttctgatttaacatcaaaagaatgtattatgaatgcaatcatgctgggcaaacaaatatactgttgcaaatgactttgcagaatttttaaaattctgtccatgtataaaatgagctaaaagtggctcttgctgtaatcattcaaataccttcggactcttgcaccatatgtttcctacattttcttttatcatatgtgattgtatattataatacacagcaattccaaaggcgaaccagatggctgtgtgtttcttagttcaggattctcaggcagaagggaagagggaatctggggctatatttggttctgatgaaactgacaggctacccgaagtgataatcagaggtatttaaggaagactcccatttacgataaagagtttaagtgctcaatcacgtctgaatgtgtctttaatgggcatatctttaaaaaactgatttaatgtattcctttacatctgctcaagttgaatacgtggagacaagcaatattttaaactagttatttttttaaaaaatacacgtttcagaaaaagcaaataatttcttggaaagacagttcaaaatatggccactcttcggctcttgcttccttattgtttaggctgctagacaattatttgctgaataaaaaaagagtgggctaagtcagcaagaaggaagcagggagagaggtgactagttttctgaatgcaattgatgggttcttgcacaagttgcttatgttgtgtcttcagcttcacaggggtgaaaacattttgtccttaagattgagatgggacaatcacaattatgtgcagtagccacacaaattgcacaacatacgtttcttgtctaatttgctctgcaacagtgtaaaaccagatgaaaatttcaaaatgaaaaacaaaaataaacacaatctatgaacacattggtggactaaactgatggtgctatagtcaggtgatatctgcatgccagccataggtatacctgcccatcccaacatgtgttcatattgaaatgtatgcagtgaagaattttgaaaattgaaaattcgaaaactcttgaaaattgatgacggtctcagtactccgggggtgaaatacagatgtgaaaaaaaaagcataaaactcttcaaaaaaaaaattctattgctgggaattagaagagctaggatttgaacaccagactctggcaacaagggctgttaacgtgctctgtgcagagaccctgctctcttctcaccacccttcaatgtcagaggttgctggaattccttccacagcccattttgtgtcttgctctgctccccatcttggagatctcaaccatactcctgcttcctctaccacctgggttgtttgcattctctctcctaggactccctctgatactccaaactgagccacccagtctcttccagaaagctccatctccagtcccatatacacatccaactcaaaatgacccaaactggactcagcattgcccactctttccccttgaacgtctttctttgctgatggccttgttatttgtttcatgctacaagaatattttttcaaaagtagaattctgatcatggtgtgttgccttagttaaattcctcaggagagtcccatgatgttcaaacatcacagcagggccaaggagacccctcatcatctcctgcacacttgtctttcctttattctctccatagggatctggtgagctatttgacttctttgcaattcctcaaatatagcttacatattcacatttattttcacatttcctcaagagagaagttgcttcctttcttttctcctctagtcatttgttaagaaccttgcatgtcctggcattttttatccccttgttccaggttgtgagttctcatgtccagttggcagcaccaggtgaagttgcaacaagggaatcatatccccacatgaagaacacacagagactgatcctcctttgctctcactgggaggaaggtgggtggtgaggtggggttggggaggcaggggaaggggagtgtcagcagaacagcaggtagcaggggatagtgaccaggttggggaaccagcaatgaggcaggggctctgaggctccatggacagaagaatggaggaaggatcaacgggcagggagtgatctatttgccacagcgctgtgaccaaccacaccacccagccctttccctacttttttaaggtcaacatttggtgagggccttaatgagcctggattctgtgccaagtacttccctggaactgctccatttaattttcacaacaatcctaggagttaggtactcatattagtcctatatttgctaatttatttatttttgagatataattcacattctataaaaaatcaccattttaaactgtacaattcagtgttttttagtatattcacaagattgtccaaccatcaccactacctaattctagaatacttttatcaccctccacccaaaaacctccatatccattagcagtcactcccccagcccctggcagccacggatctactttttgtctctataattctagacatatgtataaatggaattacatgatatatagtcttttgtgtctggcttctttcacttagcataatgtttttgtgcttcatgtatgttgtagcctgtgttgggtactttatttcttttaatgtctaaataatattctaacatatggatagaccacattttgtttacgcattcatcccttgatggacattggagttgtttccaccttttggctattgtgaatagagctgctatgagccctattttgtaggcaaagaggctgaggctcagagagtgtctcagtcagttcaggctgctgcaacagaataccatagactgggtggattaaacaatagggatgtatttctcaaagttctggaggctgaaaagttcaagatcaaagtgccgacagatctggtgcctggtgagggctcacttcctggattgtagatgattgccttctggttgtgtcctcacatggcagagagcactgagtggaagcaagctctctggggactctaacagggcactaatcccattcatgggggctccaccctcatgacctcgtctagtcataatcacctcccaaaggccctacctcctaataccattacagtgggggcttgggcttcaacatatgaatttggcagcggggggtggggggacaaaaacattcaatccataacagatattgattaaaacacaataattaaaagcattgctttttgaaacaaacagacctagattcaaaacttagcttgttcacttcctagcctgtgactttggacccattattcatcttctttaacttctatagtcaatataaagacagtaatgtcacttgagcatttaggttggcatgaatactctttatagttcacataaaggagtgctttcctcatattaggactttcatgaagagtaatgatgggaccctctgcacttggcccttcctaggtgcccaataactaattttgaatgaataaatgaatacaaaagcatgatttgaattcggatttggtcatttatcaactatgtgaccttgaacaagttactcatctgcaaaattgggggacagtagttgttgtggttgtactaggtgaaattaagcgcaagatctagtagaattcccagaacatgataaaggctcagtaaatatcagttcttttccttcatccaacttagtatttcctcttttattaccgtgcaacatacagcttaaccccacaactaggctttcaactgtacatttatagttaccaataaattttcacttttgacttaataatatttctcttctatattattagggaaagaaaagtatggcgttaaggatataatttgggagctccttatttgaataaacacacaatgtgtttatgaaacacttttgctttcagctgaatctttatttttagcatttttgttaaggcaaactttgctaaagtcaataatataaaattcaaggcatcaaaacattccacttttgcagaaaagcctaaatgtaaattgattatctggtgttctcaaggtctctgcttagtgagagaggccaaatcttaatggaaaagtcactaccatgggctccgttcatttggcaaggaatgaaaagtaggtcaggggtcggcgcagggtgaaggaaaatgtctttgaaagaactcatcagatgtcactcagggattattaatttactgaaaagtctacctttggcctggggatttactaaagttagaatgtgctggatgtttcctttgaactctgcatccaggcatccagaggaatgctggctcacttctgtgctgcgaccccacaaacctggcctgtgttatcagccagctctggcctgttgcaggtttttttctacacctgatgatgatgacatgattctgctcagactcttcagtaatgtcagggtctcaaagatgaggggaaaagaaaaaaacgatggccttcatggtgttttggtattctgctgctgttactggatcattagagttcttaagtccaaggagatgaatgctacaataaccatttagcacctggtgagaaatgagacatgcagtgtgggaagagggtgagagggtgttacggtagattacttagcagcaatataatatagtaggaaattttcaccaccatgtgctactagctttgataaatctcatactggtttgcccatcttttctattctcctgcaaatggtttataggtatatttttatgctaggctagtgtaaagtgtcaattggtttgcatttatccacttaagcactttaagaaattgtagcaaattcagagagacagaaaggagaatggtggttgcctggctttgggacaggcagaatggggattcgttgtttaatggttatagagtttcagttttataaaatgaaaagagttctggagatggatgatggtgatagttgcacaacaatgtgaatgtactaagtgctactgaactctacacttaaaaatgattaagatgagaaattctatgttatgtgtattttaccacaattgaaaataatttttaaaattatgctgccaatcctaaagctattaaaaatgttaagttcaaaagcaccagtttgggaatgaagtgcattgctcggatgctatttattatatttctgccacctatatcattttaaaacacaagttacataagaatgcatgtactttcctttgcaatcatataattatacttgtgtgaaaagtgaatgcaggatttttacattgatggaagattggtaaaatttttattggatattcataccagagatctctagttggtacaactagccaaaaaatttttagtgggttccacagaaaattaatttatctgatcagctgaaaataaatttagcagaatgtgctatgacacagtcattattcttgacggcacagctggtcacctttagcccttgatgtttcaacaaaccatttagagaagacctaaggaaagtggttctcaagtgtagccctagaccacagcatcagcatcagcatcacttgggaacttgctagaaacagcgttgttttttgtttgtttgttcgagacagagtcttactctgtcacccagcctggagtgcagtggcacgatcttggcccgctgcaacctccacctcctgtgttcaagcaattcttgtcagcctcccgagtagctgggattacagacatgcgccacgatggccggctaatttttgtatttttagtagagacgaggtttcacaatgttggccaggctgatctcaaactcctgacctcaagtgatccgcccaccttggcctcccaaagtgctgggattataggcatgagccaccgtgcctgacctagaaacacaaattcttgaggtccatcccagaccttctaaatcagaaactctggggatggggcccagaaatctgtgttttaacaagcctgccaagtgtttctggtgcatgctgaagtttgataatcagttatctaagaaaagagtaggaaatctatagcgatctaagttttttcttctgatgccttatggtgagattaaaaagacatctgcaccaagcttgcagaatgagagttggtagacggagaaaacccaaaataactgaaaaaccattaatctttgaaatggtatgtcagaaccgaacatgataaaatgataccatgttgtaggaaaaatcttacaattctgatcctagagtgattcagaagaatctttaatccagagtgcaaagaagatccagaacaaaacttagatgtttttactgaagaggaaagtagtgttaagtgtaggaataattaaatattatggtggttaatctaaaaagattttaggccttgctaaggcagttgaagggtgattttcaggtactattacttggatgcagttgtgatgtatgccccccttctaaaggagagttgcaaatggtttagttttttggtggggccagtcccagatcctagtccaaagtactgaatggttgaggtcttaagaataattacgaaggattaaggagcaccaaccactctctcagccttgacccaccagaaggatgataacgattagagggcatttctgagtaaggttagaacatggtatattgttaacatgaaactcaagacaccagggtttccaacacggctaaggtacactatgtacttaggttttcattatattctctctagtaccttctatataaagttaaactaacacgaaatcaccttatcagcccttcctggccccagggttcaatgtatctccttgccctgtagtctcccagtgtttcacatatatgtttgtctttgcaccttagtaaatggccaaattttgttcataaatctgaatcactcctgagagacttaaacccttcaagactaggaaattctagtctgtcagcatccaggtttgcatctaacacactaaaaggcttcaataaatgttgttgaaagaaaagagttgattaggtttggctctgtgtccccacccaaatctcatgttgaattgtaatccgcaatgttgggggagagaactggtgggaggtgattggatcatggggatggattttcccttttcttttctcatgatagtgagtgagttctcatgagatctggttgtttgaaagtgggtagcacttcccccttcgatctctttcttcctccttctctcactatgtaagacatgcttgtttcccctttgccttctgccatgattgtaaattgtaaatttcctgagacctccccagaaaaagatgcctgtgcagcctgaagaaccatgagtctatcgaacctcttttctttataaattacccagtctcaggtatgtctttatagcagtgtgagaatggacaggagtgaatgcatacagactaaagactgagattagggattaggattttagagaaactgtatgaggtaatgagttttcatgatgtaaaataattttttaaaacttagagactgtgtagtagaaatcttttgggagtttgtgtaggtcataaactatactctccctttaagaactgtccagaagaatgcaaacatccatcactgctgtgtccccagcatccagtccagtagacacttaatgtgtatttgttgaaagattggatctgtggatgatcctctagaaagccttgattatgacatgttaccatgcccgctttggctaaaatggattagatcaggattgtacacatgacccaaactgagccaatgagattctcttctgagaacttaaattggcactgaaagacagttggttggagtctgagtgttcttgaaatgataacatttaagtggatgatctttaaggttagatgccacatgaagaagcagaaaaagccaatcagtgggtatgcactgtatgcacacatgcatacacacgcacacggccttttaaaattttgttttacctcctttctggttcttgttcccattccctccctgaggtccaacttaatttctccccttggttctatgagacaccctgcaaataccccttctgcctaaaccagctcagttgatttttgctgcatgcgaccttgctgcatgcaaccaaaaactattaacaaatatactatcacaataattcattttccttccttagacatttcaacatttgtaagatttaaaaatcaccccagtaaatacttgtgttaatttgaattgatttctatttccttggacttcagctattttgaaatgcctacttggcctccttccatcttttgaaaagcaaagcaaaacagaaagaaccacaagccactagctgatgtgcactcttaaggtctgtgtataaattatgcctttgaaacacttggaatcttcctggggaaccatttcccagcaggggaagaaaaactaacaagtttcagaagtaaactggaaatattactcattgctatggaaaagtgcagctttgtagtaaccaaagaagtaaaaacaaatgaattatctttaatggcaggatacatagtagtcaagaatggggacctgggaccagatgacctgtttatatgttacaatcccccaactggagggtacacgttgtaaaactagtgtctagtgtctggttcttctctttgcccccctttgctctcagaggagggtatcactttagaaggtattccttagatgttttttgaacaaagactgaatgatgaaagaaaggatagtgattaagtttggagatcagactcagggaaactgcctggttccagcactcctatctgtgtgacctcaggtgtgttacttaacttgtccttgtcttggtttctataactctaaaatgaggatggtagtagacctttttttatagtgctggtgagagtattaaatgagtgaatttatgcaaaacatagaattcaatgcctgcaaaggagaaggcaggcagtaaatgttttaaatcattatgttaagataatagcttttcactgttgtatttcctctgcttttaaattttataaaaatgttggaaggaagagaattagggacatttggcctgtaaaataaagatattaaagaaatatatccctgtgtaaggtacagtaaaaatgtatttacttgttccccccaaaaatgaaattttaagggagaatatcaatataaacatgacgtgcaacacaaaattttagaccttaaaaacatctaaacttaaaaagctcatgggatgggccacataagaggtaagtttgggtgcaaatattagatcctccattttacagccagaaagcttgatgagtttctttggctcaaggggatcagctcaggttggactcgtcctggtagttgtagtgggaggtattgttctggtgtcaaatcaaccagggtcctctcctcatgcttcactcttgccatgcatggtgcaaatctaaggatcactccctaccttccccatgagtccctgaataatgtgccaggaaatactgctttttgtggtcctcctcctcatcatcaagcaattgaattattccatcttgaattgattcttcatcttaaattactttcagtccttttggctgcagatatttatgtatttgtggctccttgggcagcttgtctcagtgtaaatgggctcctttatctctgttagggtcgccctttactccgtatgtcatcttttgaatgtctttccgaggatttgactgggaatgctcattctgttggcgcaaacacatggttatatgatgacaaggagacggggctgactggcaagatgattataatgactgttactgtctagtctaggaaggcgggctcatcaggacagtgtgctaataaaagtaagattgtaggtttagaacccacatcagccagattgttctactctgttctacttgttcttttccaaactttggccttcccaatgccaattatgtgttttttgttttgttttgttttgtttgttttttagataacaataggttaggtgggagagtgtggatgaatcagggacaatctttccatctgctgcacaaataaaccagacatgctagcaccatattcccatgcagagggtgcagcattgtgacaacacaggattagttcactgtggatggtaaaggtggtaaaggcatgtatactctatcgcatcctccttctatgtggtactgccaagagctacaattccagactctcttgcagctacagtccaggtctgccttatgttccactaatcagatgcactcatgagaaatttagaaggcaggaatgaggtaatgctggcttctgctctttgccatagttggcaaaactagttgtgaacacgttgatgttttctgtttctgaattactgaagatcccagcatgcaggttgacaggcagggcacaagacattccttttgttttgttttcttttcattttggttcagacgtagcatgaatgctgcagcccctggagccaacagttccagaggtgacttcttgatctccatcttcctgattaagaaagaagaggcagtgtgccactggactagctctgcagtgcatcccagagatggctcctgcttttttttttttttttttgagacagagtctccttctgttgcccaggttggagtgcagtggcatgatctcggttcactgcaacctctgtctcccaggttcaagcaattctcctgcctcagcctcctgagtagctgggattacaggcacctaccaccatgcccggctaattttttatatttttagtagagatgaggtttcaccatgttagccaggttggtttccaactcctggcctcaaatgatccacccacctcggcctcccaaagtgctaggattacaggcatgagccaccgtgcctggccccaaagcctgctcttgaggtacaaggaccctgcttgtgctccatggacacaatgtaagcagaagttaccagcacacagtagtttcctaagcagttgctctacatacaaatgttagtaaatgcttaactaattcaacatatgtttatgggactcctaatgctgagaggctgcttagctggttctggaatccattttatcattatgcactctttgacttcgattttggcttcctcatttgtaaaatgaggaacaataatttcacccaccttataggattgtatgaaaaggtaaagaaaatgatgcatgcagaggaccagctatggcccctggcttggaggaagtactcaataatgttacttatcgatatggtatttattttgtgttaggtgctagaacacaaaaataaacacagcagacttggtctctgacctggtggagcttgcagtggatggggggaaggcagacattcaagtaaggctaaaagtgcaataattaccatgatagaggaatacatgatattggggggcacacagcaaggacatcaaaaccagcctagaggagagatggtgggaggaggaggggcagaaaggtggggtctgatatagtttgctgaaaaacagttggtcaagagctaccttgcttagagctcttgccgatggccaaattgcctagtggccaatttatcaaagtttataagtttactaaacacttatcttaagaatattttagggaaagaaaaataactttctgttttcaaccctcataaattcttagtgggaatggacccttgtaacataagacagaataacaagagaaaaacagaagtttaacattcatatttcgtatatacatggaagacattcagagaatgcgtagttctcaaagaggctttgagtttcagcttatgttgcatcttcaacaaagaacaaaaattttcagagaagtgacaagacaaaggaaaagaactttgagtctctcgggacagcaacttgtggctaggcaaataactggcagataaagtctacttaggaaagtttgttggtgtagattcctctggtaccatcttcaggctgataagggtctagagttgtttttagtggttaacacttgttcttcctggtagaaaggggacaagatacctttgtctttataaatctttgtctttcttttaggcaaataagataactttcctgcatctgcttcttcttgcttgccttcactcaacaatcttgtatattttggggtggcattttcttgtctcctagaaaattctccttgaatcttagtcaactgatgtattttccatagacacaataacttgctaaaagttctgagtttttgggcagtttcaacttcatgaagatatttttcattaatgttgctatttgtgaaaaccatgttaatgaagttatttattaaatatattaataattataaggattttatattttgaatttattgaatatattcttgaatatattctaacgcataattattcaatatttttacttactatggttaagaaggctataattccaagaatacaacatttattttcattgaccatattaaagaaaactattccttaaagggagatttcagccaatgagtaattttggcaaattcaatcagttggtcatttggcaaattaaaaattttgcaaattgatccttcagttaattggctttaaacaaactggtcatctggtatatggtgtatttggctaattggacatgacttctttcaaattctattcatgcgtggtcactatgcatctgttcttcaatttatgtatagacagtaaaacatgtagttgtgttgcctccttgtctcccagtagtaaattcacaggatattatacagaatagataattggaagagagaattggccaatgaaaatgaaagtgtggcaaagaaatgaaacatgatgacattggaaatgaaattggaatcaaacataaaaggagttaacaacagaaatagctgactgtgggaacaccaatgcttctaccattagagagcctgtagacctgcaactagaggaatttagtgaagggaaacttatggatgtaaatgaggaatgtggttgagacaagaagaatgaagatgccgcagaggaagaaatgccaacaaaacaaaaaaacttcaccctaaaggaattcacagagacaattcatgatgttgaagatacaaaggataaaatgttaaaagtggattcaaagttagaaaaggatatgacaattttcccaggcaaggtactttgtattgtaggttacataatggtgttttacaaataaataaaacactttaattttctatgttttaaattacagtgtactaaatattagctttagtatttttcatttccttatgcatttgtaactgacattaagagagttttaaagctttttaattagtatttgtatacatttaagtggtacaagtacaactttgttacttgaatatatcttgtggtggtgaagtctgggcttttagtgtaaccatcatccaaataatgtatactgtatccattaatttctcagaaatcagtagtattcctatacaacaacatccaagctgagagccaaatcaggaacacaatcccattcacaattgccacaaaaagaataaaatacctagcagtacagttaaccagggaggtgaaagatctctacaatgaaaattacaaaacgctgctcaaagaaatcagagatgacagaaacaaatggaaaaacatactgtgctcatgaatggaagaatcaatattgtgaaaatggccatactactggaagcaatgtacagattcaacactattcttatttatttatttatttatttgtttatttatttattttttagacatagtctcgctctgtcgcccaggctggagtgcagtggcacgatctcggctcactgcaagcactgcctcctgggttcacgccattctcctgcctcagcctcctgagtagctgggactacaggtgcctaccaccatgcccgactaattttttgtatttttagtagagacggggtttcaccatgttagccaggatggtctcaatctcctgacctcgtgatccaccagcctcagcctcccaaaatgctgggattacaggcatgagccactgcgcccagcctatactaccactgacattcttcacagaactagagaaaaactattttaaaattcatatggaaccaaaaacgagcccaaatagccaaggtgaccctaagcaaaaagaataaagctggaggtgtcacgttacctgactttaagctatactacagggctacagtaatcaaaacagcatggtactagtacaaaaacagacacatagaccaatggaacagaatagagagctcagaaataatgccacacacctacaaccatctgatcttcaacaaagctaacaaaaacgagcaatggcgaaaggactccctattcactaaatggtgctgagttagctggatagccatatgcagaggattgaaattgaactccttccttacactgtataaagaaatcaacttaagattgattaaagacttacatgtaaaactccagactataaaaaccctggaagataacttgggccattctggacataggaactggcaaagatttcatgatgaagacaccaaaagcaactgcgacagaagcaaaaagtgacaaatggtatctaattgaactaaagagcttctgcacagccaaagaaactatcaacagagtaagcagaaaacctaaagaatggaagaaaatatttgcaaactatgcatctgacaaaggtctaatatccagaatctataaggaacttaaatttacaagtgaaaaccaaacaaccccattaaaaagtgggcaaggacatgaacagacaattttcaaaagaagacatatatgtgaccaacaagcatattaaaaaatgctcaacatcactaatcattagagaaatacaaatcaaaaccactatgaaataccatcttacactagtcagaagggccattataaaaaagtcaaaaaaataacacatgctggtgaggttgcagagaaaaggaaatgcttatacactgttggtgggagtgtaaattagttcaaccattgtggaaagcagtgtggcattcctcaaagaactgaaaacagaactaccatttgacccagcaatctcattactgagtatattcccaaaggcgtataaatttttctaccataaagacacatgcacactcatgttcattgtagcaatattcacaatagcaaatcaacctaaatgcccatcaacagtagactggataagaaaatgtggtacaaatacaccatggaatactatgcggccataaagaagaatgagatcgtgtctttgcaggaacatggatggagctggaggctattaccctgaacaaactaatgcaggaacagaaaaacaaatacctaatgttcttacttataagtgggagctaaataatgagaaccaatgggcacaaagaggaaaacaacagacattggggcccacttgagaaaggagggtgggaggagggagaggatcaggaaaaataactattggctgctatgcttagtacttgggtgatgaaattatctgttcaccaaactcctgtgacatcagtttacctatatattaataacaaaccagcacatgcacccctgaacctaaaataaaagtttatttaaaaagtaatttctcatcccttactccactcccactctcccacccttccaagtctctaatgtctatcattccacactctgtccatgtgcacacattacttagctcccacttataagttagaacatgcagtatttgtttttccgtttctgagttgtttcacttaagattttctgtttctgagttgtttcacttaagattttctgtttctgagttgtttcacttaagataatggcctccagttccttccatgttgctgcaaaaaacatgattgcattctttttgtggctgactagtattacattgtgtgtatatatcacaattttttttaaattgtattattatactttaagttttagggtacatgtgcacaatgtgcaggtttgttacatatgtatacatgtgccatgttggagtgctgcacccattaactcatcatttacattaggtatatctcctaatgctatccctcccccttccccccaccccacaacagtccccagagtgtgatgttccccttcccgtgtccatgtgttctcatttttcatttcccacctatgagtgagaacatgcggtgtttggttttttgtccttgtgatagtttgctgagaatgatggtttccagtttcatccatgtccctacaaaggacaggaactcatcattttttatggctgcatagtattccatggtgtatatgtgccacattttcttaatccagtctatcgttgttggacatttagattggttccaagtctttgctattgtgaatagtgccgcaataaacatacgtgtgcatgtgtctttatagcagcatgatttctaatcctttgggtatatacccagtaatgggatggctgggtcaaatggtatttctagttctagatccctgaggaatcgccacactgacttccacaatcgttgaactagtttacagtcccaccaacagtgtaaaaatgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttctgcctgtgtaaatgtcttcttttgagaagtgtctgttcatatccttggcccactttttgatggggttgtttgattttttcttgtaaatttgtttgagttcattgtagattctggatattagccctttgtcagatgagtaggttgcaaaaatgttctcccattttgtaggttgcctgttcactctgatggtagtttcttttgctgtgcagaagctctttagtttaattagaccccatttgtcaattttggcttttgttgccattgcttttggtgttttagatatgaagtccttgcccatgcctatagtattgcctaggttttcttctagggtttttatggttttaggtctaacatttaagtctttaatccatcttgaattaatttttgtataaggtgtaaggaagggatccagtttcagctttttacatatggctagccagttttcccagcaccatttgttaaatagggaatcctttccccattgcttgtttttgtcagatttgtcaaagatcagatagttgtagatatgtggcattatttctgagggctctgttctgttccattggtctatatctctgttttggtaccagtaccatgctgttttggttactgtagccctgtagtatagtttgaagtcaggtagcatgatgcctccagctttgttcttttggcttaggattgacttgtgggctcttttttggttccatatgaactttaaagtagttgtttccaattctgtgaagaaagtcattggtagcttgatggggatggcattgaatctataaattaccttgggcagtatggccatattcatgatattgattcttcctacccatgagcatggaatgttcttccatttgtttgtatcctcttgtatttcattgagcagtggtttgcagttctccttgaagaggtccttcacatcccttgtaagttggattcctaggtattttattttctttgaagcaattgtgaatgggagttcactcatgatttggctctctgtttgtctgttattggtatataagaatgcttgtgatttttgtacattgattttgtatcctgagactttgctgaagttgcttatcagcttgagattttgggctgagacagtggggttttctagatatacaatcacgtcatctgcaaacagggataatttgacttcctcttttcctaattgaataccctttatttccttctcctgcctgactgccctggccagaacttccaacactatgttgaataggagtggtgagagaggtcatccctgtcttgtgccagttttcagagggaatgcttccagtttctgcccattcagtatgatattggctgtgggtttgtcatagatagcttttattattttgagatacatcccattgatacctaatttattgagagtttttagcacaaagtgttgttgaattttttcaaaggccttttctgcatctattgagataatcatgtggtttttgtctttgggacattttcgttattcagtcatctgctggatacttaggttgcatccatatctttgctattgtgaatagtgctgtaataaacatacccatgcaaaatcattatatttcgatataattatttcttttcctttgggtagatactcagtagtgggattggtggttaaaatggtagtactatttttagtcatttgagaaatcttcatactgttttccatagaggttgtactaatttacattcccaccagagtgtataacagttccattttctctgcatccttatcaacatctattattttttgactttttaggaatagccattttgactggtgtaagatgatatctcattgtggttttgtcatttctctcatgattagtgatgttgaacattttttcatctgcttgttggccgtttgtatttcttcttttgaaatatgtctattcatgtcctttgcctactttaatgggcttatttcgggctttttttgtgtgtgtgtgtgatggagtcttgctctgtcacccaggctggagtgtagtggcaccatctcggctcactgcaacctctgcctcctgggttcaagtaattctcctgcttcagcctcccaggtagctgggattacaggcacgtgccaccacgcccggctaattttttgtatttttagtagagacagggtttcaccatgttagccaggatggtctcgatctcctgacctcatgatccacctgcctcggcctccaaagtgctgggattacaggcatgagcgaccgcacccggcctatttggggctgtttataattgttgagttccttgtaaattttggatattagtttcctgttggatgcataattgcagatattttttcccatgctgcaggttgtcttttcactctgttcattctttcttttgctgtgcagaagctttttatttaaattaatcccatttgtctatttttggttttgttgcttgtacttttgaggtcttagtcatcagttctttccctagaccaatgtccaggggagttttccctaggttttcttttagcatttttttttcataatttcagatcttacatttaagcctttaatccaccttgagttggtttttgtatgtggtaagagataggggtccagttttgtttttctgcatatggcaattcaattttcccagcgccatttattggaaagggtgtcctctaccttgtgtatatttttgttgactttgtcaaagatcagttggctgtagatatgtagctttatttctgagtctttaatattttgatgtaaagtttataatttccagcataatcataattttccctgttgattgttaagatcactttgcacagtttcagcttgcaaggtcacttttacagtcctgagctactgtgcaaaggatgacttcctgcacttaaaattaggcagaagaggaataaaacctaggtctgttgtttttcttgcattctgtttgatgttcccacttcaggatatacataaaattcaagcattttgcattataagttctgacttttgggaaattgcagtgcagtgaaatggacaccatttctctcctttctctggcagtcaattcaactaaaacaggtggtgaggaacagagtattgtactcatgaaacatgagagagaattttgatgacatctggaagaatgttatctaatgctaatgctgattttcttgtgtgcttcatgattgcccgttggtggagcggagcagtactcttaataccgtcaagaacaattttctccttgagtaatcttgtctaaaagtgttctccctgattagttatttttcatcattattagaatttaagtactgtatttaagtcagacttatacaatctgggatgtaacctgtagttgtcattgtaaaaagataaacagacacgaaacccttatacacctgattaaatgaaaggaaaccaagaataagagatatttatacaaagatattaatatgaatattcgcatgcatgctgcataacccaccaagctggttctacaatagaatgcactaaaatattctatattttatgacagtctctcttaacgaaatgaaattatttctattaactatttgaaagtatgttggttagctataaaattgcactagtagttctcagggatttttctctctaaacatccccaaagttggggcactgttgtgtcattaacaaggctcccaacatcagtgtcgctttcactcgaagagggcaacaaaaatctctgaaggagatcatagtttgaaccaccgtccaggtgggtttgacatggtgaccctcctaatgagttgtcccccctcccctcaccacacacatgctatagttgggtcactgatctggagcatgcaagagttgataaaattccagcatccttcacatttgaagacttggagtccatgttgcagcttacctctgcttaacctctaatgtgcatttaacctagagctctgtatttcctcctctgaaatgcctctgccctgggttttctaatagattaaatagaataattcacacacacatgcttttagctgttaattggagatatgttttgtgtgagatatatctttctaccaaaatgtctacctgtctaaaactttccattaggatttgcaagattgggttaaaccatttatgaactgtcttatgttaagcacaaattccctagaagattgcattcatcctcaaagtaaatttatttttaatattatttaacaatgtcctgaggaaatgggacagataaaaagtcaatttagtgttggagaaggaaataatacgtctaaaatataggggtatgttgcaggaaaattttccctgagccgacgtcattaatttgtagccctctatgtcactttcctcagcacatccaaatggttcgtctgaactaagcactttaagagttggctcttacaaatccagtaaataatactattcattggtatgggaacaaatgacagaagcagagttgatatgatgagccagccatggtgtctcctaatcctgatcccagagtggacatgtaacattgtatctgtataatgtggatgataccagttgggagataattctccatgactactttcatttttctacatggttcaggttttctaagcaaaggccttggaaactagagctattgtttccctaaagttcgagccattggcctacacattcagggtggtgaagctagagaccttcccctaccccataatgggtgagattgcttaatgagtcatctttctccctttttggaggggaggatgggcagaagtgccagcaggagatagatatcagcttcaggtctcctaattgttgggttacaggtaacatgtggtgttcattccattgccccatggggattagggcttggggaactggtgcttagattactctggctgtttttgtcctagttaatagattgtctgttctctaatccagaaagcctcttgcctcccatcagaacaagccagataagatctcagactcttccgtttctgacttaatatgtactgagtggagttgttatgggtgtttgatcatataggcatggaggagctaaaagttttagtttcctcttacctttcccaatgataaactaataggagctaaccattgttatgttttattatggggcagacatcgtgttaagtattttccatgcactttcttatttaattctcaaaacaacattaggaggcaagtaaaccactatgcagatttttttttttttaagatgaggacactaaggctcagagagttgaattaacttgttcagagccacaagggcttgtcagtggcaaagcaggaattcaactcagtccctgagaaagcagcatctaaatccctaaccacttatactttcatgctcctgggatgcaatctctgattttcctatagatttgtagaacatgaccctgtaaacataaggttacaaaagaaccatttgagccatttgatgctaccctatttaataatttatatgctcttgtgcacatgggtatttccttatttagagtctaatctatgaagttaatgggggtgaaactacatcagaattgccatctgccagcctccctactgcagtatgacattaacatggtaatggctgattcccaatagggagtctgttaaaaattatccagggcctttgcaaagccgccagcactcctgactgaccactgtgatcttggaaatctacttattccaacaaaatattataataagccctctacatttgaggattaggaaaaactgtttcaaatggcttagttaaaagctgagagggagagagaaagggagagaaagggggataaggaaagaaaacaaaagaaaaaagaacatgggcagggagtgggagggagtagcaagaaaggaaagagggggaggaagctgagggagcaaggtaacagggctggtcaaagttggtattgattgaggatttaaggaaatggaccaggggacagcaaattagaaatacataatgcatagagaatctaccttctggaccagtcctagatctaagatctcacagaaagcctggaatccacaagtttacttttagtgctagaaaagttttcatgaaactctgcagaaaggcctgggaaattttcttttaggatcacgtctaccctaaagaaatcagcaaggtgttttccatagcccgaggtaggacttctagactcctgattttccagattattcttctgtcaaataatgccaatataaagagaaaattagagggggaaaataccactattagggaaagaaaagtaggtagaaagttcttgaaaaatagccaaagcaaagaaagacaccatgagtgattgggagttatagggaacttttaaaatttgaggttcaaaaaaaatactacctgaaaaagaaagtagctcctcctcttcctcctcctcctccccctcctctcctcctcctctcctcctcctcctccttctgtcctcctcctcctccctctccctctccttctctttctctttctccttcttcttctcttcttccttctttctttcttcttctccttctccctcttcttctctttctttcttcttcctcctccttttttgcatttccatattgccttggagatcaggaacagtagggagctgctagaccaagttctctatctctctgagaccttataaggtttgagggaatccgctctgtcaaatagctcacctgaattgcaaacgagattttgcagatgattatagacatctaaaactccaggttgtatttacatgggatctttgttttaagaaacattaatctgcatatgtaacaaaatagactaaggctgtgtttgtgtttgctacacatttctccaatacatcatcacagtttccaaactgtcaaggtacagatgggtaacaaacttcctacccttgtccaaaaggagaactatgagacatcccaatttatgtttctagggctttcagtgagaaatgctgggtcacatcagatttcttcaatgtattcatttcctactgcaggtgtaacaaaatgccacaaacttagtggcttaatgtaatacaaatttatcttatagttctggatgtcagaagtctaaaatagatccacagggctgcatttcttctaaggttctaggggagaatttgtttctttgccttttccagcttctggaggttgcccacatttcttggctcatagccccttccttcctcttcaaagccagcagtgtagcaacgtctctcctctggaactccgcttgtatcattatattctctctctctctctgtctctctctctctctgtctctctctctctctccctctccctccctctccctctcccccctccctctctttctctctttcttcacccccctctctaataagaaccccatgtgattatattgaactcacttgaataattcaggataatcctctcatctcaaaacccttaactcaatcacatttctaaagtctcttttaccatgtcaggtaacatagtcacagattcgggggattagggtatgaacatctgtggagtcattattcagcttatcgaatgcagtcttacatgagggtgacatgttaaaattcaagttatatgaatacattttccattaaaaaacatatgtattaatatctcatatattgatgtaaaaatatatattctctttagcacttattatagctgttttaatgtcatttgagttttggttctccagctgaaaggcatggaatatgtagtccagaaaacagaggtgctgctatatttttcttatttcttgacttgtaatttattagctaagaaattcttctcaggccacatgcctggataaaagaatagtggcagggtccttagttctcaatatcgatctatagatatctagatattgacatacagatattcaaatattgatgtacagatgtaggatttgttctaaatattgacatacatctagatattgacatacagagatttcagtaacagtaaaaatacaacacctatctataattgatcaccaattctgcttggaattggactgggtatttttcacacattatctcattatttttattattgttattttttgagacagagtctcactctgtcgcccaggctggagtgcagtggtgggatctctgctcactgcaacctctgcctcctgggttcaatcaattcttgtgcctcagcctcctgggtagctgggattacaggagtgcctcaccatacctagctaagttttgtagagtctttagtagagacagagtttcacaatgttggccaggctggtcttgaactcctgaccgcaggtgatctgcccacctcagcctcccaaagtgctgggattacaggtgtgagccactgcacctgcctcatttattatttaccagaattatctgaggccggtatacataccttgattttacatatggggcaactgaggataagaaagaataagtaacttgctcaaagtaaaaaactgattgtagttagttgcaatctcaagagaaagacctactgttctttcagaaaggggagtgtggagacccctccccagtcatatgcagacacaaattcgtgttctttaatttggctgatgagttttttaaggcacaggcaagatctctgaatgggagttaaccagttgcattttgaaaatatgaagcatctgggtcaggcacagtggctcacgcctgtgattccagcactttgggaggccgaggcaggcagatagcttgaacccgggagtttgaggccagcctgggcaatgtggcaaaagcccatctctacaaaaaatacaaaattagctggatgtggtggcacatgcgtgtagtcccaactatttggaaggctgaggtgggaggatcacctgagcctggaaagttgaggttgcagtgagctgaaatcgcaccactgcactccaacctgggcgacagagcaagaccctgtcaaggagaaggagaaggagatctgtatgaacattagatacttcaaacatagttcatctttgttactccccagtcttccctcctcccctcttcattttattttagtttattattttattttatttttgagttgcctcagttcttgtagttgaaatggcttgacagtcattactgttgtgtgaatttgctgtttgatttgattgtttcctcagttctcacaaatgatggtaacctctccttgttgccttcctcttttttttaagctactgaaaaaagctctctccctgaacatcacgccactggccagattaaacatattgatatgaaagaaataacttgaaggccacaccacttgagtgagagtaaacagtggtgagtgggggctccactggttagcctcaggggctgagttgatggtctttggtattattcaactcaaatccaagggatcatcaataatgatgacgataaaatagcctcaataatagggtagaaaattgatagagaccttttggatgagtggctttcaaagccccaggaaaattaactgatagtccctaggggagtgcctcctacggagagcaattctgaaagaaatttgcagacttctatttagactggctgcctggggaggaagggaaggagcaatgagaggcaggagagggaaggtggagaggtgaagtaggggtgatacttcaaagggaaatccttaggtttcaaatcaacattccaaagttatcacaaacaggtttgcgtgtttgcaaaagagtcttccttcctggagcttccttcaagtgcacccttgtttgaccttctgcatatttgtacattttctctaatttcatttaaaatataacccaaggtgggttaagagagtccacacgtcattcccctttcacttccagagagcagctcttagtccaagtcatcaagagagctgaggccctgtgatctgtcctgttgcctttgtctggagaccaggccaaaaacttgtaatgaatattcaaatactaatttatattcttgtttatcttgtacaaaaacacaaaactgtgcatccttctaggttcttttcctgacattgtagagaagtgaaaagaacattggacttggagtcgaaagatgtgggtccaccacttgacactctacttattagtcatgggacctctctgaacctcagtgttctcatttatacaacggggaaaataatgtctatcaggaagtattattatgaaaatcaaaagcaattgtgcttgtgaaggcttttgacaaattatttagtgcaatgcagatataagtatttattgttgcatcagaaaggaaccaggcagttttggagacttacaaaatttaaaggaactagcgtggagaaagtccctgagataacaaagaaccacaaatatatagggaacaataggaaaccataaattgttttagagctttaaagaaccttaggaacatccctcaagttacagataaggagtttgaggcactacgttttaccaggtccaacacttcataggtctagacgtcaggtcttctatttcccaattcaatgcttgttctgtagtaaaacagagttccaaaggattaataaagggccccttaggctgtccttttcaaaatgtctacacatggtcatatatgcaaacccccaaataaacaactgttggaagtaaaaccttggaaaaagtaaagagctaaaggttatacactcagagtgcattcctaacaaatggcaatcaatagattagctcattaagcaaattttacttgcactatagctttaattatggcactatgttgaaattgtataacctcctatgaagcacacaagaaaataatcattagcattagataacattcttacaggagacacagttcttaaaggactcacaaactaaggagtttgtgatgtgagtttgtgagtaatgaagagagaagagacatatacttcaattacacaaagttctgaagcttggttgtgtataagttggataagggagggatgctttcttgaggggttgtgggaaaagcaacatggtggagatagtatttaagaaggtcttggaggacagacagagctttcatgattggagttgagtggtagcagtggtccatctgttcaggaggaagagttgcctggctggggaagacaagcagagtggctgggctggatcactgggtttttattggggtgttctgggagaaaagaaaaataaatatgacaaatgaaagcatattccataaagcattcctgatgtgtgaaccacatctaaaataatttctatcatcactattcatatttgctattatgaagtcaaagtcctctggaaaatgtgtactgtgaacataatgggctgtggcagccacagattttgagcacttgtcatgtttgcccatcttcctttttctggatcctttacaaatctcctctcttctgtatgatgctagtggggctctttgtcactcaaaggggaagtagcatacaccaagtttgaccagccatggtacattacactagacgtggtgattggttcagagaggagcatggggaccacactgcaccaatcagagtcattttcaacgagaagtcttaggaatgagcagcgtttgcccttgagtttgctagaacaggaggaggtaaatcttgactggcatgtgggagttacaaagactctctccttcaacaaaatttagttagactcctctgagccctcttctcaactaaaccttgaccttgggcttttgtgcctattctgtccttggctgggcctgcattgcccaatcttagcaagaattctgctaagtcagtttggcaagaatccctccacctttgatatctaatcatccttggtatctgatcaagttctttaacccccaccattgatgtataagtccttgatctgcctttagcaagaatcctgttagcttggcttagcaagtatctccctacctttgatgtcttttctaagtaattttccattcactcacctcctcaccctgctccttggctataaatctctacttatccttgtttactggagttgagtccaatctctctatcctattacaatagagttgacccttaccttactgcaatagtcttgaataaaatcttccttgccattttaacaagtgtagtgataaattttttctttaacagagtgtagatcccctcagttcccccactttctttctgtgtcctggctgaaaatcagagtgccttgactgctctgtgacccaggcagctgcaggtttttcccataggcttgaactcaaactggggccttgaaaattcccaggcacaggtgtgtgatgttccccttcctgtgtccaagtgttctcattgttcaattcccacctatgagtgagaacgttcaattcccacctatgagtgagaacaatgcggtgtttgtttttttgtccctgcgatagcttgctgagaatgatggtttccagcttcatcctaatgtaaatgacgagttaatgggtgcagcacaccaacatggcacatatgtgacaaacctgcacattgtgcacatgtaccctagaacttaaagtataataaaaaaaaaaaaaagaaattgaccatgacatcatcacatatatctgttgtatttaaatttcaagatttcatctataaatggattaaacactatacttaaaaaaaaaaaaaagaaaaaagaaaattcccaggcacagataaaggtatctaggctgtttcccaaaacactgaaagaaactggccctggccctgagccaaattccttaaaccctgatcccctcactgccaacctacccacgtagaacatcctttttaccccgctgtccatcatgaggatatgctgcagcactctgtatgcaagttcccctaatgaatgctttgggtggctcaccctggcatttagtgctttttctttggaattccaaccggccccatctcaggacggtttggggcactccctgtgggaactcccctgccactgcttttggggcgatccagtgcattcagcagatgaaacacaggggctaacagaactcagcagtgctgaaagatggggaggcagggaaatgaccacatttgagaccctgtgcccaaaagccagatgcatctaggactttctagttacgtgagccacttgtctcctttttaattagcctagagagtattgggtttctttcacttgtcattgaaaaagtttcaataaatgtaacaaattttcattgctccaggaaactagacacagaaaattggccaaggtagtatcaaagacagaaatccaagaatgtccagatttcctcaggctctcctccaatggcattgggaataacagttggtatttcttatgagtattttgttcttccaaaaaattaacattttaaaaatatttgttggaagacagatactgagctacatggttttacataggccactttatttaatcctgcctttcacagaagtccttattttacctaatatatagataaggcactgaagtccaatgtgctttaatgcacattggactgtgtgccttcaaattcaaaccgtggttctttcctccacacttctctaaatatcctttgacaaggaatttttttactttgtttcttttttccctttgttaaaaattggagtgaaaatttacaattgcagccattctacattgtttcttgattagtttcttcaaactcatgcaaatatgatagaaaagaatgaaacaatcttaaatttatcatacttgatttctgtccttcctttagtaacaataaaatatatacctaataaagtgaaaggaggccttaatgggcagagacattatatactccctggaaagctctatgatgttcctaggattttactgcttgattgcattgaagtgagagcccaaagtgtagacatttgcacagcacagggacaacattccacagccctctcgtgaaagcacttttactaactttcaaactggacaagcaaagtttctgttttatgagggttttccttagccaataactattgtgaatctctttgaatcctaaaggcgttaagtttcataattggataccaaaattatgttcccaatcttaaatctgaataaagttacttactttttaaaattttttattttaattaattgattaatatttttgagaaagtgtcttactgtgttgcccagactggtctcaaactcctgggctcaagtgatcctcctgcctcagtcttctgagtagctgggactacaggcacaggccaccatgcccagcacttacttttttttttttttaattatactttaagttttcgggtacatgtgcacaatgtgcaagttagttacatatgtatacatgtgccatgttggtgtgctatacccgttaactcgtcatttaacattaggtatatccagcacttacttttaatctatctgtattttaaaaactatgtgtatctaattcattttttctttgagccaatgtatctttaaaaataattttcatatgtttcctctagaagaaaaaaatccagattcatatttgttaccttataagaaagccatgctcttcataagtaatgtctacacaaaaagcactatctggcattgttattagcattgccagatagtttgtttgattcgggactgtgagtgatacattgtttagatggttgcatagcttgttaaacttctgatgaggtcttccagttcattctagaggggtcaaacacagcattttgcatagtgccctgcatatcttacacactcaataaatgaaccattataacccagtctattgtggctttcgatttctcactttcagttggagcaggaaacaggatagagaaaaggtgaatgacaaagagatacatcacagagacttacactgtgatatagtcttacagtataatttcaagtacatagtatcacaaaatctggcaacattaactcatctgtggcattgagtgggttgttacgtacaattgtttctcttttcttgaaaaacaaatcaatacaaatcaaaacaatcctgcccattgcaggcttttgcaaacatgaatattttccagtaataatatagtgttaaagtttcaaatcatggaaatataatactcaaaatggtttacctctctcctttccccatccctcccctctacccccatttcatcctttacaaaattaaaaaaaaacataaaagcatatgtcaagcatgtttcagtatgtgtcaattttagggacaaacccagagtccattaatcagttcaatatgcagttccaacatgaaacaagaaccaaattccatctctcccttttaaaaatagacgatttttagagcagttttagtttcacagtggaaattgagcagaagatacacagagttcccatataacttttgcccccatacatgtacagcttccccaactagcaacatcccccactagagtggaacatttgttacaatgggtaaatctacactgacacatcgttatcacctaaagtccatatatagtttacattagggttcattctttgtgttgtatattctatggattttgacaaatgtataatgacatgtatccacgattatagtatcatacagaatagtttcactgccctaaaaatcctctgtgctccgcatattcatttcctctctcctgcccctggctgatttttttttattttttatttttttactgtctccatagttttgccttttccgcagtgtcatacagttggagcaaattcccctttaaagtaacgcagaccatcaatattaaatacaattgtttatggatatctataaaaccaaaaatcctttatgtttctctgctccctagtgttataatcatatactggataggtcaaccactttggggggagttaaatcttgaactcttacttctgcttccaaaattgagacataattagtttataaatgaatgcctaggtcaggaatgtaagttttttttaataagagaaaaatcaattaatgttgttaatgacaagaaatatcatgtaatcatgtcaatagatgcctaaaaggcatttaataaaattcaatattcatgattttaaaatctcgataaacaaggaatagaagaaaacttctttaatgtctcatgaagaatatttacaaataaattacatcaaatttcacacttaatgatgacatattaaatgtattcctttaaaaatcatgtgtacaagaagaagttcttactgtcagtagttctattcatcattatattattataggaattggaaagaaagaaaaaagaactcattattcatagataatatgattatctatgtagaaaactgcagatcatttgcaaataaagttttacaattgctggatacaaaataagcacacgaaattaactgtgtttctttttaccagtaacacacagaagatagaagaaaaggaacaattataatagcatcataattttaaagtatttaggaatgatttccacagagttttatggaaataattacaaggctttactgaatatcattaaagaacattaataaaatggagtatcacacaatatccatagatgtgaacacttaattatctcttgctgcagaaccaattaccccaaacttagtgtttaaaacaacaagcatttattaactcacagtttctgcaggtcaagcattcaagagaagcttagttatatggttctgttcatggtcttttgtgaggttgcaatcaagatgtcagctgaggatgtagcgacctgaaagcttgactggggttagtggatctacttccaagctcacttacactgctgtctgcaagagacttcagttcctgtctggctgttgactggaggcatcagttcctcaaaacataggtctttccatatggcaatttgacagttggcttcctccagaatcgatgatccaaaagagaaagtctcgaagtcatacatcatcatttatgctttttctaactgttagaaacaagtcactaagtcaagctcacactcaatgggaggagaattagtctccatcctttaaaggagatgtcaaagagtttttggacatattttaaactaccacgacactcaatattataaagatagcagttgtctaccaatttatccatagattcaatgactctcaataaaaagcttaatggatatagtctaaaacttgacaaactgatcgtttatatagaagcacaaacggtcaagaatagcccatatggtcttgtccgaagaagaacgtgatgggagaacttgcctttctagaaattcagagtattctatagctctaataattaagactgtgacatagtgcgtagagataaagaagttgactaggttaacacaagatatagagccacacatctggaaatctgatttctggaacaggtagcattgaaaatcaatagggaaaaggtacacttttcaataaatgatttggtgacaattttttatccatatgtaaaaagttacatacaagttgcttgtaaatcgatgataaatctaaatgaaaaaagcagactataagacttgtagaatgtaatataggaaaataatttctttttttaagagaaaggcatgaatatcttttatttgtatactcaaaatctagcacagggagggcagagatgagaacatctctacattgtgtcacattgaaaaggtattattcatgatcatacaagaaaaggtaaagacaatttgacatccatgctttcagtatttttgttcttccttgtggttctataccttttagtgagatctctaagaactccaggatgaaatttaaggtttgttcgttttaacaatcaggaacagtcaaagagatctatttttctctaatactaagtggatgattaagagttgtagaataaagagtgggttttgaaaagttctacacgttataaataggtaaaactttaaaatagaaatttctcaattacacatctcagaaggtaggatccgcttaggtccttaaaggacatgtggatttcttaaataagacataaaatgtacaaatgattaaggagaagattgataaatatggctccttttattaataaattaagaacttttatttaccaaaaaacatcatagacttccactttaagccatactaattttcaaactgggcaagcaaggtttctgttttatgaggattttctttcaccaaaaaatatgttgatgcaatgcaactgcaatcaacttgctttctcaccttaaacaactacaaaactggacaaaatataggaaaacaactatttttagccattggacaataggtgtaaagttgtaatccataaaaagaagagaaataaacaaggtgggttctgtgattgctctggctttctacctggagtcactttctggaatatcacacagtattggggaactcaagtagatcatggcagtctctataaattgaggaaacagagatcagagttcaggaagattgggcagctaaaatttgcagagcagagtactggagaggagagaacttgcagagacagagctctagaaatatccatggactccttgaagttttggctcaactgcatacacgtaggatgagattccataagaaccactactagagagtggtaagctgcacaattctcagagttcacatggggctgaccaacctgagtggagagacctcacaaaacacgtgggcattcagtagagacctaaaagtgctgagcatgtgattgagacctcttcttagtagtagataaaaactggccctagacaaacctaaacccaccataataaaatttaaaaccaagcctcggaagcatcgaacagattaacatataatcacatgctaaataaaaactcaacattctttaaaagaagacaacaaaatctggaaaacaatgtaaaactcataatgtctgggatctattacaaaattacaaaaaatgcaaataacatttaaatatgacccataatcaggcaaaaactcagttcatagatacaagccccaaaatgacggagatgatgtaataagcagaagacaaggactttaaaacatagttattataaatatggtgagcaatttcataatgaacataatgaggagaaaaatggaagatataacaagagcaaaattgaacttccgtagatgagaaatatgatttcaaaattctcttggatggcttaatagcaggttagacactgcagaggaaaatatcagagaacctgaagacatagcaataaaaccattcaaactacagcacacagaggaaaaagggctgaaaaaagaaaatggaacttcagtgaccagtgggacaatattaaatagtctagcatatggacagttggagtcccagaaagagagggaggcaggaaaaatactggaagaaataatgtccccaaattttctgtatttaatgaaaactatatattcaaagaatctcaacaaaacccaaccaggggaaacacaaaggaaatcatatcaacgcatatcataatcgactttctgaaaaccagtaataaagaaaaaattaaagaagcagatagggcaaaaagacatgttatatataggaaatgttgtaagaataactgctgacctctcaacagaaacaacagaagccagaagaaaaggcacatcttacagggcttaaagaaaaattggtcaatctagaattctatattaatgaaaatatacttcaaaaaaaagtgaaatgataatctttcagacaaacaaaagctgagagaatttgttgccagcaagtctgtcctacaagaaatcttaaaggatgttcttcaggctgaagaaaaataataccagatggaaatgtggatctacacaaaagaatgaacagcacagggtgtggtgaatatttgcgtaaatacaaaataggctttctcctttgaaaaaaaaaaaccacagttctgtaacagataattgaccgtttaaagaaaaaaaaagtaatgtattgcaagtcaagttgtctcctacatagaaataaaatgtatggcagcatcagcacaagaacaggaagggggacccagaaggctcctgtgtgaatgttggcacactatctgtgaagtgtcttgatggtatttaaagtggagtgggacaagtgaaagatgcatattacaaacccaagagtaaccactaaaaaactaaaagaggaatgactaataagctcactgtggagataaagtgaggcaggaaaagaaaaaaaaataacaaattgagacaaatagaaaataaatagaaatctagttagatttaaacccaaccatatttatgatcccattaagtgaaatggtctaaatattccaattaaaaggcaaagattgccagactagataagagatgcactttaaatatattataaaaacaggattttaacatgaaaggtgcaaaagctgccacatagtgtgtgaaataaaaacccaaaatttgggagaagatacttgaacctcaagaaattgaagaaggattattatccagtgtataaaaataactcctatacgtgaataagaaagaggtaaataatccaatagaaacaaaagagaaaatatttatggaagaacttcacagaagaaaaaccaaccaacatatgaacatatgccaactgtatcataatcgggaagtacaaattaatctaggacagaacaattttaatttaatatatacctacgagattttaagaagtggagcaataatgcacttctgcactgttggtggtgctgtaaacttgatcattttcttgggaaaatatgtttgcattatctcaaaaacttgaagatacacatgctctatgactcagaagttccatcctaaagtacaatcccttgagagattcttgggcttgtatatcaagagacatgaacatgaattaaaaagcagtatatttataacagcaataaaactggttacaacctaaacatccatcaacattgcacagataaataaagttgcaatatattcacacaataggagactatactacaataaaaattaataaactaaaactacactcaacagcatacatgaattttaggaacatagtattaacaaaagtaaattgtagaatcatacattaggatgattgtgtttaattttcaaaaaattcctctcatacatgactcatacaattatgggaggaatgtgtagaaggaaaaattattcaattcacaaaagagaaccagcaggatggcaaagctgcttctaagaccacttgaggaacagagatttatgtagtcgcgagaaggctgaaatgcatttgcaaagttaagagacaaaactggttatatcccacagggcaataaaataataacctttggggttatcttctctacccagcagaaatacatttcatctatactggaaaaaaaatgtgcaagtcaacatgtaactttccagagcctgggccctggtcaatagtagataaagagaattatagtcatctagagaatttaatgctccttgattagcctgttgggtaatgttccagtatggcattgaaaggacacgaggtcagttgtaagttgtgtgtacatttttcttaacaattaagtttataagaatttcaaaaaacttaaaaccaaacaatattttcacaaatacaagtgataaaaactacaagcaagaaatgacaaacacaaaattcagaataggatttacctctagagcagtggttctcaactaggggtgattttggttcctgtggacatttggcaatatctggagactactgtggacatttggcaatatctggagactactgtggacatttggcaatgtctggttactactgggggagagggtgctactgacatctagtgggtagaagccagggacgacgctgatgaacatttgacaatgcacaggacagcctgtacagcaaagaattatctggtctcaaagattagtagtgctgaggttaagaaaccttgagaaagggagtgaatttggggtgaggcacatagggaacaaaataatggtaacattcattttctgaaattgattcagtgatgcaaacacatgaatgtattttgaaatgattttaaaaacatgtagttttttaaaatttctactcaataattaataaacacaataaagaagaaaatgggactggatgcggtggctcacgcctgtaatctcagcactttgggaggccaacgtgggaggactccttgagcccagaaatttgagactagcctggacaacatagaccccatctccacaaaaaatacaaaaattagcaagatgtggtggcacatgcctgtagtcccaactactcggtaggctgaggtgagaggattgcttgagcccaggaggtcaaggctgtagtaagctttgttcacgccattgcacttcggcttgggtgacagagtaagaacctgtctcaaataaataagaagaaaatgttgggtcaacagaactttggactccttggacatgcaggttggggatgaactttctgttttgagcaattggataaatggtggtaccatttaagactacgcttttttttcctaaaagaaaaggctgctcagaacctatttctagacacttagcattttattgagacggaaaaacagctcttcacaattagaaatattgtgaagatgaccgtaaatgcagactgcatttgtgaactacgacaaacctactaactttgagatttgtgagtcaatgtcgttttaaatcctgctggccatgagtcactgtttcaccttcccttggggagagtcaaaagagtaaatccagcagtgaggccgagaccttttagcactggaaacatcaaatgagcagaggcccccaagatgtcacagctcaggcgcccgttagctggcttcaatgccctcccggagctagctggcagcatgagtcagcgtcaactagaggatggaggcaggtgaaagcaattcccagtaagcccaaagcccagaccaatcagattctccagggggtgggcctagggcatttctggcttcattctgaactcccacataagttcgtggttaccctgggctttaaatgaatgaaaatcaagttttctgtgattacaaacaaatgctatatttggtgccacaggtgcagagagctgaaggtctgctatgtgtatcttatactggaatgaaccggaggagacagaatgagatatggaatttagggaaacgtgatcttttttacttttggattatgctctgatttcccccttaaccatgtagttgaattttcacacatgataacaataatttttcttgcagcagatggggccttttatgaaaggggtttgcaccttattttatctttcataagtctaaaaattatacgtaaaaaccccaaatgtgagcagctcacctaaactctgccaaccctttgtgtttttaaacagccaacccggaggcagtgggactagtcaagtcttaaaaatgtgtaatgaccctcattacagaaatttgaaatgctgtccaatctcaacccaaattttttttggggaaaaagtctgcccaatgctaggtttgggcacagcaggatgatacgctgtgagtccaaaggccaagccaacagcagctccacgaaggtagagctcgctcacggttcattccatttaaaacatgtgccatatttgaaaatgggatccctacctgagtacactcccctggtaaagataacagctgtggccttcatctaataggattgttttcctggatttcagcagagttttgaaagtctcaatatataaaagatgaaaaagagggaaagatccctttcagaagtagccatcatgcttgggaaaattcttgggtcacagaatggcagagactgaaaagttttctaccctgaatttgaaggacaggaatgtatgtaatgaaagactgggtattaaaagaattctgtcccacccgttaagtccctgtgtgatcctgaaattttctcctccttgctcttgatccactttcctattttgtgagataagtgtttcagacctgtaatctctggggtcccttccatctgtagcactccatgattctaacagctaatgaagtttcatctgccagaatattctttcttctcccactttgcttgcgttttagggttcatatgaagctataaaaattgtatctataaggcttactgcctataaattttgctgttagcccaatgtatgtgaagtggctcaaatgaattttggcaaattttggtgtgggtcattggacctcagagatgggaagtggtgatggaaatggaagaaatgaagggagatttagccccttctttgggtttgtttaaaggccagtcagtgcacagagaaaatgatggatgaataggacagaccttacccagacttcacagagaaagacaagactgggcgtgtacttggtgctgggcagaggacagcaaaaccactccatgaatgtctggtttgtgggaagcgagcatggctgaaatttatcatagtccagttgtattgcttatctattgctgtgtttgtgtctcgtggcatggcttaactgggtccactgcaaggctgtatcagagtggtggccagggaggtcggggcctcccaggtgcaggtgggggttcttcccagctcattcaggttgttggcagcatgcagttcccagcaagttgctgagctgagggccccagtttctcccaggccgatggccacttagccacatggttctgtccacaggcagctcgcaacatggcagcttgctttttcaaagccagcaaagagagagggagatgccaaggagacgggcactctgtcaggtacaggtaatcatgtccctcctatcacctttgccataatgaatctaaccactctataagaggcaagttgcaagtcctacctacactcaatcagagggagttacacaagagcgtggacactggggccgaggcaggggggaacggggagccacactagagcccatctgccacaccagctactcccagggtggtccctgataattaattatgtaatcaagccactaatccactaaacagacatccactgggcatttatcatagattggccctgtgctgggtgctagagcacacaaagaaaaagagccatggtccctgttgcgggagtacccagatgagggggggatgccagcttcctcccacacttcagttctgctgttctgtgggtgactgcggtgacattgcagctgcagctgtgctgagcctatgtttggcactctcctccactcgggactgctaggctggctgggagctcctcagccttcagagtgtgttgtctcaatggcctccaaagctcgcagctcctcctcttggtcacctgtggccgggctgcccctgctcggccctgactcacttcccaggagccagagggccctccccggagtccatccagccccttctcagagctcttttccagaacctctgctggtgtggtaggtcaggctgtggggtggggatgctgcatgttcctcaaggtttctctagacccaatccatccacctttgcaagtaagtcacaccccttctcagaagatgtggaatctgagatgattcacgtgaaggtgattttgaggaaaaacctataggtcaggggagacatggtactaggttgtggggactagtgagggtgcggcatcaaaccaagccccatggagggaagctctggagacagaggagttatattcagggcaagggacctggggacattaattaattgccccatttcacatattgctctaacactgtatttaaatttccccttagtatgagttctaacttagtctttagaatttcgattgagaacaggtttgtcagtctcatcactattgacatttggggccgaatcattctctgtggtgagggtcatcctgtgcactgcaggatgtttggcagcatccccgggatccacaaactagatgtaaggagcacccccttctagttgtgacaaccaaaaatgtttccagacattgccaattgtccccgcgggggctgggggtggggacaaaattgcctctggttgaggaccactgcttgagactgaaaaccctgctaaacctggactctatgtttcttgcatggcactgcaagtgatcaggaaggggcaagcattgcaggtttcccgtctccattattgaactagaaacttcttgagggtacaccttgtctgcctcaaatagtgcccatactggttgcaaaaaaggtaaaaaattaaaggaaaccccttcctatcaaatacaattttaatcagaatcatctagtcagtgatattgtacatctagatgccttagatgcttgttgttgagtaccagtttctgcagcaaaagagagaaggctccaccccacacaagtctccactgggtactaaagagtccaccgcctgtctccagaaatagtaaatgatgagatcttgaaggaagagaatcgactacctatttagtcacaacctgaaacaatatgaatggaaagataagccagatggagactttttcaactcctgtctataaacattatcatttttactgtggttgctctccctcttcccatcgtgtataccctctgcaaatagaaaaaggagaggtggaaacttctccctccctcccttcctttcttcctcttcctcttcacccaccctccccacacacacttcttccttttcctttgattctgttttgctgaattatatgtttaaatttttgcccatagaatgaatgctaaggtcacagatgggttcaggaaacttaaacagaatgaaactttacccactggatgaaggtgggtgatgggcaggaagccactattagtgaaatacctgtgtgatagaattgacttagtcagtttcagccccgacaaaccaacccctcaaatgcatccatgaagtgatgaattttcattagaagcgtttgggaatggtagtggagattcattaacgtaactcttagttctattatctttttgaatgcttccctggatttcagaataactataaaagaaaatgaaggcatgaaagaggcaaaacagtttcagagtcctgtgtaatcccctcagtaacatcactaggcaaagggcatgcaggcaacatgaagaatgggccacatttacgttccatggctatctgggctcaggtgtctccacatccaggttctcagagcatccagttccccttggggcacagatctgggtttcctctcccctgtgtttcacatgtagtgcttcttccttttacatatctttagtagccacctgtgaaaaagatgtcagaggagtttatttacatatttccaaatcattcccagcaagggcttcctctgcctccacccaggaaatggagtttgctgaatttttcacttttcaaatttgactctgtggattacaaacattagtgttgctttagtttctcttgctagaaaatatagaatctgtttctttttgtaaattgtgtttacaaaatgttttagaatttctgactaagcgaaactaaattgtgaaaagatcagtttccgaagtgtttcacttggcgttgaactagatgttagtgcatcatgtatttattcctgcagaaagtctttgaaattttttatttgaaaagtcctttgaaaaaaattgttaaggttctgatataagtcaggcatcatacccaacaccgtgagctcacagatgtgtacaacagtgcccttgccctgtggtatttcgtcatctactgggggagtcagaaatataaatatcctttagaattataaggagcttgaaggcagggactagcgcctaagagctcaatcaatgcctgttaagtatcactagaatgagcttaaaaatcaggcttgaattataaaaaaaaatgccaaatataatgaaactgccaaaataaccatagaaagtttagaaaataaaccttgatgaaacttaaacgagataaaaagatggaagacaggaatgttgagaactctcagatattcacttcatcaaggcacagaattggacctcatgtaagttttagctcctgctgaaagttctgttggcatccctagttggaggttggattatctgaattatgatcctggtcatcttcactgatcaaaagaaaagccagtttttcatttggaatagattagtagcctcaaacatgaattgattggaacaccacagtcaataacgcagtgactgcattcacaatgacaaccatttagtgccctcgtgaaagtaataaggatttgtttccaccacctatcagcctgactcggcagtgaacccaaccctgaattaactattcctctcataaaacgaaatgccagtgtctccctctctgctgttttggttgtatatccttagtctttcgtcacttgatgaaattactgtagtattcatggctagcatgcggaacatcacagtttttgcagttcttatttctagaaccttgtccttcccacaactttaataaggcccaacatttgtattctttttagcatatcttcttggatacactcaaaaaaggcagagcagtgtatttagagactcgagtccctaactttgcaagcaaatagaagccattttcttaaagatcaagaaaagtgaatccctattcttttttttctttctgggaagttacattttataaatggtttagccagatgcgctttaaattaatagcacacttgtgaaaagtcttttccgtggaagcagatttcatcaccaccaaatgtcactagagtttcttttttcctgaagtctgcataacctaatttgtgaagagtcagttttggaggtgcagggtggggtggaatggcatatgctttgccctgggcctggctcagggctggcattagagagcattcttcctcatgtcaagcaggtactggagagtccagactggataccaagtcaaacttgcattgtcccgtgctgtgacctcaagttgattctggaagtgtgttttttacttcatgttgaagctcctttagtctcatttctggacatccagttgtacttgtctcttccaggcaatctttaaggtaaacacgtggtgttttatttgaagagctacaacctgagccctcttaatcggtctccgcatttgggcttgcagctggaaagcatgttcactcatgctgcatttttaccatacaggaaatcctccaggggatgctgggtacatgtggtacctttgaagtaccaccagcaattttctctttcctacttttcctctgtgttttgttacattaattgatgtattttgtctgatgtattaagagagcttgaaggatgatgtgtttagcacacagtatctattatgattaagtttctttgcaggaatcacaacacctacattatgactctgctcactacccctggagctgggttacaacgacgcaaaaaacaatgctttatcatgcaggaaaatcactcagacaccccatatctcatgttcctgctcagagctggaaatttataactcgaatttgtttcaaattttaaaactccattatttaaggcatgtatttcctccctttatgagtcctgtatgtctaggcaagcctttgatgatacaaatttctgtgcacattcatatacaaatgtagtttgtgagtgaaatcagacttattatttattgacagaagggctccatcgtgctaatacaactgacttaattagcatgtaatttaagtccaacgaaggtagagacaaatatcaatcctgctaacgtgcatttctatgtcagtttaaatttcatttaatggtaagtccttgaaacttaaaaacactgatattttcctttcttctttatagctgcatcatgcttggaaataagaaatgtccaaagacaatagcaggattctctctgccttgtaacgtgcttcagagaagaaaaatgagaaagatccccttactttgccaataatatttaagtccaaccaattcacaaggtctctggaaggaatcttaagaataaaaacacaacatttatttaaaaccaccaggttgccaggtgtggtggctcacgcctgtaatcccagcacttcgggaggctgaggcaggtggatcacttgaggtcaggagtttgagaccagcctggccaacatggtgaaaccccgtcttcactaaaaatacaaaaattagccaggcgtggtagcatgtgcctgtaatcctagctaccctggaggctgaggcaggagaatcgcttgaacctgacaggcggaggttgcagtgaaccgagactgcaccactgcactccagcctgggtgacagaacagactccatctcaaaaaataaaataaataaatacaaccaccagattttcttgtcatatatatacatactggaatactattcagccgtaaaaagaatgagatcctgtcatttgcagcaacatggatggaactggagatcattatgttaagtgaaataagccaggcacagaaagacaaatattacatgttcccactcatatgtgggaactaaaagaatggatctcatggaggtagacagtagaatcgtgattaccagaggttaggaaaggaagaggggagagaggattaagagaagttggttaaggggtacgaaaatacagttagatagaaggaagaagttctagtatttggtagcacagtagggaaattatagttaacaataatttattgtatgtttcaaaatagctggaaggcaagatttataatgctcccaacacaaagaaaaagataaatgtttgaaggatggatatcccaattacctgatttgatcattacacgttgtatacaggtttcaaaatactacaggtgctcccaaaatatgtacaactattatatattaatattttaaaaaccaccaattttttttacttgagggagaacagcaaagaggcacagcctcaaatactattttagaaataatgtctgcagaagtggataaaaataattatgtattttctggccattttgagcctttcttttggaatttctgagttgctttttattgtacaagtgagacattgctcttaaaaaaacttcctccttcacatttttttcctttgatatttaaattgtgcttaaatgaacctagaaacatacatttctccataaaagctccaaataatgaatttgtgatgatcttctctctgcttaagtggtcagggaagctctgacctttgaaaaggtggaatagttttttgtgtgttaactgaagcacaagcaagagactcaataagccaatttatgtttgatttgatctcaagcatgtcagagttgatttatccaacccagatgacagtgggaaagaggcagagaattgctgagattgaaacaaataagagttgttttcaggctgaatagtgcctacaaaatccataaagaattcttagatatattttcagtgtaatgaatgagattcgggaattcagtgccatagcttgacatgaattatagtttggactacacagcacaaaaggttctggaattcacaagataaatgttttatgtttactgagctcaaaatggctacttcctagtttatgttctaataataggtgcatctaactccatcttttaggattttaaatctacacatttaagaggaatactagtcctgtgagaaaacttaaaagttgcttgatttacaacttaattttttattactcttgttttaaaatacattttattgtgtatatttaaggtatacagcatgatgttatggaatacatagataataaaaagattactacagtgaagcgaattaacatatctatcaaatcacatcgttgccttttttcgtttttatttttgtggcaagagcagctaaaatctactcatttcttatgaatcccaaattcagtataattttatgccatgtagtcctcaggtggtgtgttagatctccagatttgttcatcctacatacctgctccttcgtatcctctgacctccatctccctattcccacccctggttaactcctgatttacagctatcaaaaggaatcctctgctgcattatttactataaaacctaagtccacttaggatctgatgagtcatttggtgccttttttgactggggacccttctctgcagcccagaatgaatcatctcttgggccccacgggtcctcacagcccctcacttcacggctgcctcagcctacccttctgcttaggtgtcaggaagcaggaccattccatggacatctgagaacataaactgccaaagctgttggttgtaggtctgagtgtgtccaggaactgtcacaagagcaaaataaggaatctcacagagtcagagttactggtggagacagggtttgcaggaaggaagccaacgctagttttgttgttgctggcagcccctttccttcatctgccctctgctgcttcattgaccctggcaacttgtccaggatgctatgattgagaggtggtgccacagagggtctgaatcaatagcttctcaagcatgctggttattttttttatcagtaagtttgtctctgttcaaaactattgtaaagctgaagtgcttttgttctgctaaagagatacaagtctattcctgatttcaccaaggacaattcaatttttcaataattttaatgaagactttagtttattgaaagatacttattaaataactgaaagattagcttttattataactttcagcctggttctacaaccaacggattagttgaaatgaggctgaattatcttatcttcttttccaggggaatttggagtcaaggaaaggctcatttctgcaggggtatggtggagaaaatgcagggaataattggttccattcatttttaaattccttataagaccatgcggaattaattcatattcaaagagaattgaacaaagcctaagagaaagccattatgttttcacagacttttttcttggggaagagctaacttttttattttttaaaattattattatactttaagttctagggtacatgtgcacaacgtgcaagtttgttgcatatgtatacatgtgccatgtttctgtgctgcacccattaactcgtcatttacattaggtatatctcctaatgctatccctcccccctccccccaccccacaacagtccctggtgtgtgatgttccccttcctgtgtccatgtgttctcattgttcaattcccacctatgagtgagaacatgcagtgtttggttttttgtccttgtgatagtttgctcagaatgatggttcccagcttcatccatgtccctacaaaggacatgaactcatcattttttatggctgcacagtattccacggtgtatatgtgctacattttcttaatccagtctatcattgttggacatttgggttggttccaagtctttgctattgtgaatagtgccacaataaacatacatgtgcatgtgtctttatagcagcatgatttctaatcctttgggtatatacccagtaatgggatggctggatcaaatggtatttctagttctagatccctgaggaatcgccacaccgacttccacaatggttgaactagtttacagtcccaccaacagtgtaaaagtgttcctatttctccacatcctctccagcacctgttgtttcctgactttataatgattgccattctaactggtgtgagatggtatctcattgtggttttgatttgcatttctctgatggtcagtgatgatgagcattttttcatgtgttttttggctgcataaatgtcttcttttgagaagtgtctgttcatatccttctcccactttttgatggggtggtttgtttttttcttgtaaatttgtttgagttcattgcagattctggatattagccctttgtcagatgagtaggttgcaaaaatgttctcccattctgtacgttgcctgttcactctgatggtagtttcttttgctgtgcagaagctctttagtttaattagatcccatttgtcaattttggcttttgttgccattgcttttggtgttttagatatgaagtccttgcccatgcctatgtcctgaatggtattgcctaggttttcttctagggtttttatggttttaggtctaacatttaagtctttgatccatgtcgaattaatttttgcataaggtgtaaggaagggatccagtttcagctttctacatatggctagccagttttcccagcaccatttattaaatagggaatcctttccccattgcttgtttttctcaggtttgtcaaagatcagatagttgtagatatgtggtattatttctgagggctctgttctgttccattggtctatatctctgttttggtaccagtaccgtgctgctttggttactgtagccttgtactctttagcagtgatgggcagactttttcatagaaagttcatttgtcagaatttcatatatcacacaggaatctccaagcctagtgagaaaggtcaccatctcagaactcacatattttgtcttatgaatgcaactcatacaaacatgtgtatatatgtgatgttcaagtacatttaggtccatggttctcaattgtgactgtgtatcagaatcacttctaggaatgattgagtttgaataggattggttatgcttcaataacaaatggtacccaaatctcatgacttactacaacaaagacttagttcttcctcacaatgtggatttattgtgggttacctgtggctcttctccatcttatgttcactgtgacatcaaggtgacagagtagcctctagctggagcattgctgtttgtcatggcatagagaagagaagagtctggctgactgctaattgactctcaccaccactgctcagtttcattggccagggcaagttacagggtgcagcttaatggtggggctgagaagtctgattctccactcccacccccgcccactagcagcagtgaatctttgtgaataaaatgccttggttgacttcttactaagtaggaatcttgggatgggacctggggaatggtatttttaaaatttatctggcaagtatgatgagtaggcaaggtggggaaacactaacttacatgagaaaagtctacattaggtcattgcagggatcattatcagttttttatttgttatcaaaaatatcagattgtgtatattttatttttatatattattaaataattaggagaattaggggttttgcaagggtttttttaagtttcaagtatctttttctgataagacactcttaatttataagtataaaataattcaacattgacatttgcttaatggaatattatgatttatttgaagataagaacaccctctggtgataaagtgtgaaatatccacaggtaacggatgagatcagtatatgagtaaaacaattctaatccatgaaggttctgcctaggcagccatttggccttgccctctgactgtctgtttgggctcagtgctaactttgtagtgacatttgcatcacctgtgtgggtgaagtaaatcaactgtgcttgctcatgtgtttgtagctattgagtgttgggtattgtgagctaattgtccacagattaattccatttggatactcattgcagacatacaaccataggagccacactagtacaatggaaggaaccctggattcaagttaaaatgtacttcctggatcagtcctaaatacccataacactttattgggctgtctcttatgacaggcttctcttttgctctgtatattagatgtttatgcacacaaatattacaccatacagtggatatgggggtggactccccaatatccattttaccccattccattgtgtaggagctatttggttggcagcatcaactccactccaagcttcaatgtgagggctctactggcataaaccaatcctaaccccatggcttccatgattggtgtcggtaactcatacctaagtcaatcagatcatggcaatccctagctacagagattcattctggagctgtcccatcagaataaagctgaaactacttttgctgatattccaggaactcgccccccacgccctgccttgtgtagtgtggggtacatctatgaaacctggaattctataaccattttcccaacatgctagaaatgagccttaggataacgttgaccctgcagaaagcagagtgaaggggctgaaagaaactaggcaccatgattgagccaccctggagcttctgctacctctggaatttacagaaagttgttgataaatcccctttattgcttaagccagtttgaggtgctttttctgtcacttgttactgttaccagaagaggcctgaagacatacactgttagctccttgagcacaagctacaaggttttgatctgttttttggtcctatgtttaacacagacctactacgtgtctttgtactaagtaggtctttattgaataactaaatcccaaatcatggtcttatatggcactaaagattaattcattgcatatgtaaatagtatagaattgtgagtgttttccaccattcacctgaatcacatatgcttggtttgtggtgtggctgagagccaaaagagctgctcagcgactccagaagagtctcccaggaatagcctgttgcttattttctgtcgccagccactcctctttgaaaatggtttattggattctgatgtacatgaactgctcagtaactccagcgactctcccaagaatagatggtggcccgtgctgttggatccattactggacaccacttttttgaggatggttggttgaattgtggtgaaaatgagttgtcaatgtgtcctgaagcatgtttgccccacctacttggtgaacttggtgatttgagaggatcagaactttctttcacaactttgtcagcttcagaaatgttggtcttttgcttgtggttccaaagcaaacatgaaggtgctctgttaactttcttctgctaattgcacatacctggagccagtggatgccgagactggcacttgttcacctgtcttcttattttactacaagacaataggtgtgaggagcagtaattagtccttgaatcacatacatcagtctgtttttggacctgaagcttttggtgggggaggagggaaggtagggaaaaggattggaaaggcccttaggcaatattgactctgggcccttaatctgataaatccctaaactaatgcccagaaaaatgaaatatttttccccaaatgactatagagctagtacttctagagcttatgctcacacgtgttctcattctttagctactccctttaggaaatgccatatactgagagcacttcaacccaagggcactattgttccttatctgaactactgtaatgcgctcctaacctctggccccatgtctaccatgctgtccctattttcataccggagtctgagggagcccaatacgccttcctttgaaagtcttttcctggtgctagcattctgaacactatagccaacccatgtagcccatcctggcccaattaattgatcaagcttttctttttttctgagactaattaggtcccatgggttcaaacaccaagataaggggtgctgtccacttctatgtactatttctcatttttttctgtcatcccatttaatggtgaggtcagtcattctcaaataatcacttagctctcctcaaagtcccaagttattgatatgattataaatatccttatatttgtaaaataccaaacatagatatcttggcctgatgaatctgactgatttttataacaggataattggcgcccagagagctcatggagaataaacaaaatgtggctttatctaagcttatgtctgtttgcgaacattcatgttccatgtagtataaaccaacagttcccaacatgggatgacgttaggagtctggagacattttttattgtcatactgtgtaggaggtgctagtgtcatctagtaagatgtaagaggccagggttgctgtttaacatcttacaatgtagagggccaccacccacaacaaagaattgtctagctcaaaatgtcaacagtgccgaggttcataaaccttggtgtaaaccatctgatttttatgttagcaggctgtagcatagtatataagcagttattttcttttcatggtgttatcaatgtgaataaatggattctttcatttcagtcaacttatttggcaggaaatacaagtctacatgctagtaggaggagagaaatatagaaaaagtagagtgaagataaaatttataatttatagaagatgaaaataatcattgaattatggaccttgcaatcactcctcaatggaaattaaagcaatcagttgttccaagaagctgtttctggaggatgaagggagaacactgtcaacagcattgggctcatgatttttaacttatctgaagcacagaatggccacaagcaagtgtatcctcaaaatcgatgaaaaaaaatcttcaagttaaatgcaccatagctgaaaaataagatcattatgtaggaaaatatcttggtgatatttttatttttgaagctcctgtaagacttctatatgcagtaatcataacctctatttgagggcttcctgaatacagcaactcgtagctgtgctctagatatttctggaggtgcttttatgggttagaaaaagagaaaaatgtgactgaacacagacaagcagaaagaacatgggagagtagtggaatgaaagggcaaagactgggaagatggctggacagaaagaaacagagatgttattgctggactgtgcaggtaacagaagtgtgggattgtcccaagatcccaagatgagtcccttaggggaagtgaacaggaggggatgatggcactgaagagaggccatgaagcagacagtaggaaagtgggagacctggcagcctggggaggcattcgtcatcttgcaggacactgaaggcttctgcagctcagacaacaacaggcatgccacccataaggcgcccttacagctgaaaccaatgtggctttgttagtgtcagaaagctgtgctttcaggagttcctaaagaaggcatgggaagtgggagaagcctgaagtggacaggactggagtccttgctctcatgcaggactccagttgaaggacatgagttatgagcactgtgaacacaagtgacttagtgcagctgatcagcatactgacactttcagaaatactcagctctttctttttccctttttgtcatttgtatctcttcttttgtaatatgataatttttgagtttaacattgaaggtgctcattttaaagccatgtaaaacatctttattcctagtagaggtttttggcacgtgacaggtattgagtgaaggaaagcccatcattatctattaacttctaattgggaattaattcatcaccttagagcacacttcataatcagactggggattcatgagtattggaagagagtttctttcagtgaagccaggatataaaacgtaccaggtacttaagatgaaaaactaaatcagagtggtctctgccctccagaatctagcagtagtcacagattttgaacaatatttgcagtgtcaagcaaataaacttaacattctaattttgtccattgccttccagagaatcaagacgtgttggaatttctaattgtgttgaagagcaaatataagcaaaacttaaaataaggctggggtgtgtgaataggcctggaggctttgcgcttctcatagcatttgctgcaactcttgtgacgtgataaaatattttgtgtcttcaaacatcctcgcaccatgaatcagtgtgtaaattggaacagcctttagggaggacaatttggcataggtatcagaagttttaaaagcattcttatcatggcgtgaacccgggaggcggggcttgcagtgagctgagatcgcgccactgcactccagcctgggcaacggagcgagactctgtctcaaaaaaaaaaaaaaaaaaaaaaaaaaaaaggcattcttatcgtttgaaacactgattgctcatctaggaattcaggccaaagaaacaaatatgtacatacacaaagctatatcatcaaagaatgtcattgaagcattgaaaatttggaaggcacaattcaaaggtctagaaaataggctaaattggataaataaattatggaacctcattagatgaaatgccaagtcataaaaacaaacaaacgtgctttcaaagattatttaatgatatggggcacttttcatgatacttttagtgaagccatagcttataaaatggtacactcagtaagttctagtttttgtgtaaaaatcagaggccacaacatatgcacaaatgagtgattactggtgcttctctccaggtgatagaatgtttctttttttgtactttcatatattctgcaattttttcattaacatgagttaattaggtaattagaaaaaattctttcaaaactcaactttgcctcttcgcttttgttataagagtcacaagttagaacagtctcctgtccattttacaggccatgggataaggtaaagaattctatgagaacatcatttactgtatcaacagctcagcaacataggtactatcattatctctattttacagatgagggtgtttaacttagagaacgtaagtaattttaccatcagacatagcaaaaaagggggcagagttgggactccaagctgggtctacagagccaggtatacaatacccaactcatactctacttcacaaagtgagttttaaaatatgggcagaccttgtcttattgcactttggtttatcacattttgcaaatgatgggcttttttgttttgttttgttttgtttttgtttttttttgttttttttttttgtttttttacaaattgaaggtttgtggcaatcttgcgtccttcaagtctatcagcaccatttttctgatagcatgcacttactttatgtctctgtgtcacattttggtaattcttacaatgtttcaaactttttcactgttattatatctattttggtgatctatgatcagtctctttgatgttactattataactgttgtgtcacacaggacagcaaatatttaaatgttgtgtgttctaactgctccaccaaccagccattttcttatctttctccttttccttgggcctccctattacctgagacacaacaatattgaaatcaggccaattaataaccctaaaatggcctctgagtgttcaagtgaaaggaagaatcacatgtcccttactttaaagcaaaagctagaaatgatgacccttagtaaggaaagtatgtcaaaagccaagataggcctaaaactaggcctcttgtgccagtgaaccaagctgaaaataaaaaaacaaaaacaaaaaaactacttcagggacaattaaaagtgctactccagcaaatacatgaataagaaagcaaaacagccctattgctgatgtggagatagtttgaatggtttcgatagaagatcaaaccagccacaacattcccttaagccaaagcctaatcctgagcaagaccttaactcacttcaattctataaaggttgagagaggtagcaagctgcagaagaaaagttcgaagctaggaggggttggtttgtgaggtttaaggaaagaagccatctccataacataaaagtgcaaggtgaggcagcaagtgctgatggagaagctgcagcaagttatctgaaagaccttgctaagatcactgatgaaaatggctacactacaacagattttcaatgtagatgaaatgggcttatattggaagaagatgctatctaggactttcatagctagagaggatgcctggcttcatagctagagtcaatgcctggcttcaaaggataggctgactctcttgttagagtctaatgcagctggtgactttaagttgaagccaatgctcatttatcattctgaaaatcttagggcccttaagaatgatgctaaatctactctgtctgtgctctataaatggaacaaaaagcctgaatgacactacatctgtttagagcatagtttactgaatattttaagcctacttttgagaactactgctcagaaaaaagattccttttgaaatattactgcccattggcaatgcacctggtcacccaagagatctataaagagattaatgttgttttcatgcttgctcacacaatgtgcattcttcagcccatggatcaaggagtcatttcaaacttaaagtcttatcatttaagaaatatatttcataagactatagctgccatagatagtgattcctctgatggatctgagcaaagttgatggaaagtcttttggaaaggattcaccattctagatgccattaagaacatttgtgattaatggaaggaggtcaaaatatccacattaacacgaatttggaaaaagttgattccagccctcattggatgactttgaggggctcaagacttcagtggaggaagtaattgcagatgtggtagaaatagcaaaaaactagaattggaagtggagcctgaagatgtgactgaattggtgcaatctcgtgatcaaactttcatgtatgaggactttcttcttatgggtgagcaaagaaagtgatttcttgagatggaaactactcctggtgaagatgctatgaaaattgtgaaaatgacaacaaaggatttaaaatattacaaaaacttagttgccacagtcttggcagggtttaagaagactgactgcaattttgaaaaaagttttactgtgggtaaaatgctatcaaataatattggatgcagagaaatattttgaaaaaggaagagacaatcaatgtggcgaactttattgtcttattttaagaaattgcctcagacaccacaaccttcagcaaccaccatcctgagcagtcagcagccatcagtatgcaggcaagaccctccaccagcaaaaagattacaactcactaaaggctcaaacgttagcattttttagcaataaagtagttttaattaaagtatgatttttttagacataatgctgttgcacacttaacagactacagtatagtacaaacataatttttatatgaactgagaaaccaaaaaatttgtgtgactccttgcttcattgtggtggtttggagctggacccacaatgtctctgaggaatgcctgtatgaactttctaatcccaatgaacatggtatgtgtcttaataaatgcagtgaaagaatattaaccatgaaaacaagctcttgaatttgaagacaagccttcacaagtcagttaatccagccctgcagtgaaacacacaatccatcttgctgcccgaagttgtttctgtgcaatatgaaaagtggaactagaaagtctgattgtctgctatttagtatagagtgttttgtgctctgtgatggttcagaagtttcctgctttggtcctgtcaacttacccaggctggcaaaacatagccttctaccaactgatgtgatgttgactagatttgtagctgaaaaaacccttgaaacctttctacatcttctcaaggcccattgcaacaaatgctacttattaaaaatttgctaaaggtaagggtgtagaaaaccaccaatttttatattgcacaaaacaaaggatcaaggtggagtctttgaagacattataaaactgctgcctaatattcatgcatagagctgctgtcgtttgtgaaaattttaaaaataaaaacgtagcacaactaaaaggaaaatttcataaatagctacaccaaaacctaggcttaacaaaaaaaaaaaaaaaaaaaaccaaaccaaaccaaaaaacacattttcttccaacacagccaaatatggcaattttttttttttttttttttttttttgatacagagtcttgctctgtcacccaggctggagtgctgtggcacgatctcagctcactacaacctctgcctccttggttcaagtgattctcatgcctcagcctcccgaacagccgggattacaagcatgtgccatcatgcctgactaatttttatgtttttagtagagagggggtttcaccatgttgcccaggctggtctcgaactcctggcctcaagtaatccaccctccttgacctccaaaagtgctgggattacaggaatgagccaccacacccggcccaaatatggtgatttttatatgccatatttgaacttggagatttttagaatggaaactaaagatatggctttcaaaggaaagcctcctggcccagcaggtattaacactttatttatgggatttttgcctaatctcctccacgagccaaacggcaaagtgttttttgtctcctgtctctgaataatatgcaaaccccctttttatttccttttttgtggtttgtttatagtaaactctacaactggtaacaatttctccccatccctgtgaccattaccagcatctgaatacatacacatgagcgctaattggagtccaactgggttccccaataaacagaccgtaagacaagggtttgggaacaagtatttatctgggaggtggcctcaagatgctggtggggtgaggggaagtgagatagagaagggaaggcaaagcattgttgaatatagtgttcgatatcaagtagattatcactgtgataaactggtttaattctgctgggcaccccaaaaatctggataaagcgtgtgcttcagagtcatcccatctcaagaatgagggagctgaggtattgatactccaactcccatcagtcattgattgagggtagttctgaaaggatataaattcccagcttgccccaattgttattgctgccccaatagcaacactatcactggcagccagagaatgtgttcaggcaaaaagcaatgcaggtgctggctgttgggggttggctggcatgtgctgatgtaataggagtgaggggatatgagtgggacactgacagacagcttctgctacagactctttcatcaaattagtatttggatccaaaatatattttctcccactgctctctgaagctaggaagcatacccagaaaatttgggaggctatttaaaagagggtaaagtggtagtgtcacatttgacagtaatttttttcctctagaaatgttgaggagaggcatatcctatgactgatcaattctctcctagcctaaagaaagtgtcccatatgtgcacacagagacaagtaccaaatttttattgcagcattttttgcaatagggaaaaaatggaaacaaccatatgtcctgtaatagaaaaagttaaatgcaaaaaggaaggtgttgaatgatggatccagcatatcatgtatatcatgtttaaagcatgcaaaacagtattatatattgtttatgcatatctacacatgttgtaaaagcacaaggcattaataagagtgatcaatgccaaattctgaaaggcagttacctctcaggaggaagggaaacagatgggatgaggaaagagagacacagggaccttgaactgcatccaaaattatttattttttagaacaattatttggagcaaatatggcaaaagttttaaatgtgacaattttttggtgggttgatggatgatgttctttagaacatgctctgtacttttctgtatgtctgaaacatactaaaacaggaaaaagtaaaaacacaaaaatataggttttttagcatttacatttttgccttttttttttttgaagacaaaattaggtaacagagtgatggaatttggacttttccctgcaatggaattgaagtctgaattttgagctttgtggtttcaattttgaattttctagttttaagtttgaattctaatgttgtgcatactgtgtgattgtattcacttacaacctaattatttcctttccctttctgggtttttgaaccaagaaatggagctggttcagcaagatgtccgggactgctatctagtagtgtgtttctagtcgaagctgtcagtcagtagcaccaaacataaaacacagggcccaggcaagagaaggagagagaattgctgcttttgaagactttgattctggaattttgtatgtctgagtgtacaccaaattcctgtcaaaacacaaccatctgtgacattccaaatttctgggtgaaaagcaataaaacaaagagccagtggatttgttattagtcacgtgaccaggtcaggaggtagatcacatggatgataaatcagcactagctcacccagtctttcttggacagcctggcttccagatttctccatactccctctctgcttggggtgagagcagccttaggcaaaaccaagaagaaagcaaagtttgtcatccttggcttgccctcttcagcacttccgtgtaaggtcaaccacaagctgacaaacccttttaaaaaatcgacagtatatcacatggtttcaaatgcaaaacgtacaaaagggtgtacaatgagaagtctccctttcagcttccttcttcaagtacccgggtccccaacctagaggcagtcgacattgatggaatattttatgtaccattccaaaaatatgttaaggctatacaaatgaatatatgaatgtgtatttaaaaaaaacagagaataatatgtgcatggttcaataacttttttccactgattatatatcatggatgttgcatcatacaagtatattaaaactttctcgtttgtaaatataatgtataatattatatcgtatggatgtactgtaaattatttaaatagttccttcctaataggtatgtaagttatttcaaatatttggctattacaagtaatgttgccatgaataagattcacatgtgctagtatttgtagagtattcgtagaataaattctcaaaaatagaatttctgggtcaaaaggtatatgtatttacaattgtgacagaaatggctggattgctccataaaagtggaaccgttttatacccccaccagcaatgtgtgggagcacttgttttcccaagtctcatcaacagcctattatcaaacttgtttttatatttgctgaattaatacatgagaaacggtatctcaatgtgcatttaatttgcatttctcttattaccttttcaattgttgaaagtcatttttgacatgggaaatctgctttcaagggtactagaagttctaaaaagccctcttggtgtaacacatccagattttggataaattataacattgttttttaatgcaatttctggtctgcagtaaagggaaataaaattatgaaggcaaactggtaataataataataacgatgaaaacaacaagagtgatgagaccagggaagtgggcaggaagcaaacagaagttttagagttatcttgggcatgaatgccactattatggtggggagggctgggtgggaggagaaaattgaatagcaaaccacaggcttcttgaaaatgagggtgttggctcagagactcctgcattgagccaggcccctgggacaggttttgggttaaaaataacattgatgataatattaataaagataatgacaataatgactataatgaggtctcccttgttaatctgcaaccacagacttggtatcacttagattctggtgttcaaacttatactagtcctaaatgtggataaattaaattaaagtagtttcagattagtagctcctaagagtttatcagaggtaaatacaaatatttgctaaaggaaataacaattatgagctcatgataaaaaaaattactaaatacgtaaggcaacaagccaatatgagtgagtcagcaaaacaataactagaagttgttgacctctaggactgaagatgttagaattaacagataaagactatgcaagggctttatgtctataaaatgtttaaagatggaataacaatgagcaaggagcaggagataatttaaaaaaatacctaggcagattttaaaaataaccaaatcaatctcttaggaataaaaaatcattgaaattaaaaactgcacatgcatacataggtagtaaaactataaagaaaagtaaggaagagattgcaagatatgtcagggaagtggttcatatagtgaggaaagagcaagagtgtgaatgagtagtgataggtggagatttctgagtacttataatgtcttaattcttgacctgggtggggaggttgtgcagatgtttgatttatggttacttaatttgcagaatgttatctttcagaaacttttctgcatatatgttgtatttcacaataaaaatgattaaagtaaatgatgtatgttttaaacagcatccacataggtgaagaaataattaatgaaattaaataaagacataaataacccagaatgaagtaatgggtgacaaggagctggaaaatatgagagattgaagagacagggaagataaagaaggtctaatgtatatctaattgaagttccataaggagagaacagaggagaggaaatatttgtacagatactggctgagattaaccagaactggtgaaaatcatgaactcacagatggaggaaacaccatgtataccaagaatgagaaataaaaagaaacctgcacatagacatatagttgtaaagctgcagccgatgagaaaagacattttcctcaaaggaatgggagtcagatgatggggaatatcttttaaaaagttgccagaaaacaactctcaacctagaattgtgttctcagcaaaagtatacttctagaactactgagaattattggaacttctaaagggtttgttttaggatgaagaaaaataaattcagaagaaatgtttgaggtgcaagaacaaatggtgattatataaacttaaaaaattatacatatgcttataaaagcatatggaaatataaatgaacattatccttataaattaacaatacattgataaaaatattatctaaaaaatcttcagaaaagtagtgtggcaagtgggaagaaatgatttgagtgctaaggtctttgaatttgttaagaaaagagtttagatatttattaattttatactttgtttagtatgcctggtatatttttaaggctttaatgtctaagccagtagaagagaaaataaaataaatcaaacaacctataaaagccccaaatacctacaactcaatggaatcaaaagatagcaaaaaaaaaaaaagaaagaaaaagatcagataaacataaactgaagaaacaaacagtgtaagaacagattgtaaaagcaaggtacccatctaaaacataagaatacagaaagaaaaagaatggagaacaattttcaagccaaatgacaattcaaaaaaagctggagcatatcaataactgatactaatatcagaaaaagtagatactattacaaaatgtataatcaaagagggtatatatgaaatgacaaaaggtttaataagagatgtataacagttctaaacttacatatacgtagtaaaatagtttgagttttgtttcatactttgaaagctctttgacattctcagacctcaaaaattaccttgtggtttcttctagtacttttattttttaaatatatgtataatgtaaccatgaaagtatatatacatatttcatgtatttatctgatactcatccttgtatgatggatgagttatggaaacttttgtatttttatttttccctgatttttaacctgttgtaccatgcccaatttatcaactaattcatagctttttcattgatttgagatgtcaattttatcagatactgaaatccctggatatatctgggtctgaactttctattttggctcatttatctttttatatttccatactccaccctgttgaaagtgctgtggttttatttttattttttgatttagagatgttttctttattatttatggatttattttatttatgcatttcagataacaaagaattattgccatctaattaattcagtgcatctgggtagttgtaatcaatggtcactaacatagcataaggacagacattatgtacatcctaatggatgtctacaacaccacttgtcaattactctcaccataaaaatgaaaaatgaaaatgaatcttatcaagccactagatccaactattaatttcttaaaaatacaggggacagaagaatatgttaatagataaagcagagatgcatttaacaaaacaagtgttgtggttttataatatgtcctagggctggtcttcctttatttttctatttttttttccaagaagttttctggctatttttttctcatttcgttttccatatcagctttagctcttctatttaaaaaatattgacattttcattggggatgttgtgtacttttggtttaattcagggcaacctgacttctttagtcttccattcaacaactattcattatacacttactatgtgtctgtgatgttctgagtggagagatagagcagagaacaaaacagccaaaaaaaaaatgtgctgctcctgaggactttacattttaggtgggcaaaaggcaataaataagaaaaatgaaggacaaatatatagtatgttaggtggtaataggtgttaaggagaaaattgaagccaagactggtcattaggagttggggggtgggggggtgggaattggctgtaattttaggaaaagtggccagaggaggcctcagtatgaaggtccactggagaaagatctgaaggattgagggagcaggccatgtggatatttggaaagagaattccaggcagagagagcagctagcgcaaaggtctggagcccttgtatctctggagtatccaactgacaacaaggaggcagtgtggctggagcagaacgaacaaggccaagtgtggtggagatgatgcagagaggtaacaggagctggagcattcagagactggtaggccattctaagcactctggggcttattatgaatgagatagaaggctttgttgggaggggcttaaggagagaactgatatgatctgactttggctctaaaggatcctttggctgccattttgggaatattatagaaggaaagggagacaaggaggtgtgggtggaggagtgggcaagcctattagaaggctatgaatacaatctagccacaagatgatggtggtatgtttcaggacaacagtagcaacagaagtgagggaaaagtggtcaggctgtgtatatgagaattgaccaaattggctgatgaattgaaagcagggtgtgaaagacagagaggagtcaaacataactaagatttttagcctaaacaactgcattaatagagctgccatttactgagatgggaaagatcatagaagagagatgatttgcgttgaaggatcagaagtttgttttggatatgtaaagtctgacttgcctattacaaacaagtggtactgtcttgttagcagttgaatagaagattccagagcccagggagatatacatttggtggttagcagcatataaatgctgtttaaagacatgagactcaatgaggtcaacaagttagtgaatgtagatcgaaagaagaggtattaggactaagccctgggatgctccaaagttaagaggtggggatggggttaaggaggaacacagaagacttggaagttgcaaacagtgcagtcaaggtaagaggtaacaatgttgtggtttgttggaagtcaagtgaagaaagtgtttcgtggaggaagaagtggtcagccatgttgaatactgctgataggtcaagttaaacaagtactgaggtttgatcattggatttagcaaagtggtgatcaagggtgatcttgcagaggagtaagatcatggaagggcttaattggaataggtttaagagagaatgtaaggagactctaggacagatcttcgaggtagctgccattgacagttatctgacaaacttatccctctgatgcagtcccaattcccatgtgacttaggaaaggatgaccctctctaatttaataggtaaatcctgattggtctaaattagtagctctcaatcagggatgattctgctccccaggggacattgggcaatgtctgaagacatttggggttgtcacaactggggtgtgtgtgtgcacgcacgcatgcatgtacacactattggcatctagcgggtggagatcaggggtgctgctaaacatcctataatgcaaaggcatcccttcaccacaaagaattatctagcccaaaatgtcaatagtgctgaggctagaaaccctggtctaaattagtcattgtggttacattttccttggtagtgattaatctaagtattgatatgactcagtttggccaatgaaataataagaactctgctgaggagtttctgagaattattccttagctcttagaggtataaggaataaatggtgcctcttctttggatagagacagtcaaattggatatcatgcttgaaccacagtaaccttcctgctacctgtctaaagacgaagcaacacctgggaatggcagagtttctggtactttcaaacgaaagtatctgaattgatttaacctccaaactaaaaagactgctttagataacataggaaggttatttgagtcacatttcttagacaggaatttaatagccaggttatctatttaaaatctgccataaggaaggaagttatatcatatttttgagaatgtgttaagagtgacttactactatatgcaaagactcaagtttcatggttcaagtgcctacttgaacatcactactgctgtcccctcaaattagaattgaaatttctttttaaatctccagtattacctagcacagtgctggggaggtagttgatacatatttactcattagaagttagacaacttatctggattagttattttaaaacttttgcaattagtagttgggtagacctaatcaattatctaaagctagggagacaaaataggaaacataactataatagagatggagtatagtcagggtactcagttccaggtaacagactatacttccatagtagcagacagagatgtatcacaggcagtggtgttctggtaaatgtttatcagctctcaaaaaattcctgatttaggctgggcacgatggctcactctgtaatcccaacactttgggaggccgaggtgggtggatcacttgaggccaggagtttgagaccagcctggtcaacatggtgagaccctgtctctactaaaaatacaaaaaataagtgtgcgtggtggtgtgtgcctatagtcctggctactctggaagctgaggcaggagaatcgcttgaacccaggaggtggaggttacagtgagtcaagattttgccgttgcactctagcctgggtgacagagtgagactctgtctcaaaaaaaaaatcctgatttgtagcattttccagttttcatggtgtaaatatacttgcttcatggcagatttcaggctaccaatattatgtcactgataaggaattagaaagagatgcacacaattggctttcataagctggtgtgagtccgctccaacaaatcactgattacagggtattagttagctctcagaatctagaggaccagggatgctttagctacatagacaggtgtaatacaaggagacaggggccactgatccaacagtgttctagaagaaatttccacccttccgtcatagcctgttcatcaatacccatgttgctaaggttcaaatggagtaacttcctagaagttagccaagaagaaccaaaagtttccaccaaacaattttaatatcctacacatgtcaatcaaatcacgtttctttttgctaccttccaaaatcttgggctagtcgatctgtttggcagaatcctgggtcccatgcaaaatgcaaagaatctgaaaaaatattcaagtttccagcctctttattacagaaaatcatgctgaaagtcaaatggaatgagcattggagagatgattttcagtacctcctttgtatagtaagaaatggtgatgcagggtaggcaagccccaaattggggcttagcctaggagggttcttggttttgctcaggaaagaatccaagagtgagtgagctggtggtagaagaaaacaactttattgaggcagcagtgttacagctccatgactgctcctgcagagcagggctgccccatgggcagtgtgctgagactagcagctcagaggcagctctgcagtcatatttatatccacttttaattacatgcaaattaaagggcagattatgcagacatttctagaaaaagggtggcgactcctgagtcattgtgtcattgccatggaaaggggtagtaactttcgggtgttgccatggcaatggtaaactgacatggcacactggtgggcatgtcttatggaaaggtatttctgccccctccctgtttttagctagtcctcagtttggtccagtgtccaattcccacctccagagtcgagtcttacctcctacctcaatgagaggaggcaaatcagaataataaaggaaaagcagatgctaacaagctgaaaactagcccagcgtgtgtgtgtgtgtgtgtgtgtgtgtgtgtgtgtgtgtgtggtggtatttaaaatgtaagccactttaaaccaatttagtaattgtcagatataaatatatcctacaaaagaattgcaacgtgaccaggaaaattttgggcactttatacaaataattatgtgtgaacaggaacaaactatggcacgcgagttaggaaaggatgaggagagtagagagggagatgccaattcatctcaaaaatgggtcagttggtctagtgaccaatttgactactggtgtaatcgcttcaaatttatattttcatttatgtgtattgattactgtaggggatatgtatcatagctgtggttacccatgatctttttaagagcatttctgtacttggggaaattcacaggtcatgagtcctcagcagaacaacctattgtttctggctgcctaggactgagggttgtcctgggatatggtactttaatattgctaaaactaggcaagtcctggcgaaattgggataagttgatcaccctagattttgcctcctaggtgtagaatcagagctcaaatttccaagctcttttgctgctaggatgtggcatgtaaccaagtctctgctgtttagaatcaaaaagctaccccagccctcagttcaaagctgagctaggaaggaaagacactgcagtgagcttccatgttgccagcagggatagcagtccagctggctgcctttcaggggcgggagcagtggctgcaagttagagtccctgatgcagaagagctggaggctagaagcgctatcatttgtaatcaggctgaggacctggcacctggggcttgctggtggcagcagtaaggcagaagcggcttctccccccgcccccaaatcaggctaatttgctgcatggttttggcatttttcctggaagtgatgccgtggatttatttctccagccctaccagtgattctggagctactgaatatctttcagtagcttaaacttgccagagaatggattccattgtttgccagtcagaatcctgaccaataaaataaaattggagtatttcatatatggatgatggatatagctccttttaagtatatgatttttaactgcctttttctattaaaaacatcttttgatagctatttgcaaggagaggacagtcaaactgcttaagggagattttgtcttaatttcatgttcctaatatatcttcatcaaatttctggcactgcagttatgattcttcatgctgcttttgttctttttttatttttttttggctttttgacatccttgtgccccattgggtttgctaagcaaataggtgtattctgcaaagatacagtgagaaaatgtggcaaatctatgtgtgtttatttcaattgctctgtttttttcacttgttatatattaactttttaatatcactcaaaaagttttttctcgttttcctaaattgcaagccaaatttttgttattttctaaataagctttttattttgaaataatgttctatatatagaaaagttgccaaggccggacacagtggctcatgcctgtaatcccagcactttgggaggcagagagggggtggatcacttgaggccaggagttccagaccagcctgggcaacatgacgaaaccttatctctactaaaaatacaaaaaattagctggacatggtggtgtgcgcctgtagtcccagctactcaggaggctgaggtaggagaatcacttgaatttgggaggcagaggttgcagtaaactgagattgtgccagtgcactctagcccggttgacagagcgagactctgtctcaaaaaaaaaaaaaaaaaaaaaaaaagttgccaagatagtacagagttcccatatacttcatccagcatcccccaatgttaataccttacataatcgtggcattgctcttaatttctcataacacctaaattataaagaaatattggaccttaaaatatcatgtactatcaatacttggagaatatcttctcataaatagagggtatttgtattttgacagcaatagctttctttattctttgcatccaatcttactatttattttgacatggaagcatctgctgcctgcagccttcgctccatgtagaactcattctggccttgctgtttcttgttgatgtgtgtcaaaatttagatgtgcttggatggtgtgtgaagatcatagctaaaatgtgaagagccaatcaaaggtacagtttgttggaggtagcccctagtgaacataagcccaacatttcaacacctagttcacacagcctggggaaaggaggagggcttggcaacaaaggctagatgtccaatccccctggactcacactataccatagcatggagattctccaatgtcattgtacatatgagacactcttgttcaaatgcagatcctgatttagcaggttttgggtggagcctgagattctgcatttttgataggcacccactgatgcttgtactgctggtccatagaccaccctttgagtcacaaggtcatgaagacgatttcactggccatgatgcggttgtcataaatggtattaaaggagccatctttgccacagttggtgctaatccaaaggccagaatcaagtgaaaattcaaagtgatactgttctttcttgtaatacggatttgcatcactggctcgtgtatttcttttgatatcttgtcacctttgttgtattctattggttagaagaaaattacagctttcactcacactcaaagggaagggattataccagggtgggactccttgagggccaccttggggtgtgtccaccacaagactatatgaacggtctctgaaattagttaaatattgctaaacatataatacatttagataaccaattatgataatttaagtttagcctctaagatcctggagaggaagtaaactaaaatttatggaacacttaccacgggacttggtcctagaagatattggaaacatttatggcttttttgaacttcagagttgaaaacaccctccatagtcacacattatattaaggataacacttggaatagagtgagttattttgaattgtgacctaagttgatatttcatagaagactttcgtgtagtttgatactacttcgtggccaattgtgtaaggagtacgtgaccatatgccagtagagcagataagaatagggcattgggggatatttataaattaaatcagttctcaatgtagtaaaaagacttgatcttactactgttttagaattctcaagccagattgaaagtttggcttgaaatggaaactgctacccatgatataaaaacacaacttaagtttaggaacaaaacaactattttacatcagagtggctataatttgtgagtgtgtgtttatgcacaatttattctgaaggaccaaaattttaaaaccacatgcaacatttctatattttgtaagctattaaagtcccaactgaggaaaccagaatctattaaggaaaacaactcaaatggcacaaaacatgctgaagattacagttcttcagaattcatacctgtggagtctctctaatacctggctataggagaatattttcagacagtaaactccttgactgctatgagagttgagaattctgcttcagggtaactttagtgtaataattaattgaacttgataatcacaaaggagtctgtgtggattcatgattcccagagaattggtaggcctctgaccatgggccgctggtgagggggttgccccttagagattttccactctgccaagaagacctctgagcagtgtgcatgttatttataggaaaagagctgtaaggggaggggggaagatcagcttcttttccctgctctatgttaaaagcccacagcaggtttctctctctgaataggacataccctacattctaatctattagataattaagctgatgattagttataataatactactataatttaatacagtggtgtgttggtttcctagtgctgcttaacaacttaccaccaatttaccagcttaaaacaacacatatttattttctcacagtttttttaggccaggaatctgggcacagctgagctgggtcctctgctcagggtctcacaaacttgcaatcaaggtgccagggaggttgttgcattctcaccagatgctcgactggggaacattctgcttccaagtttcctcaggttgttggtagaattcatttccttgtggttgtaggactgaggtctccagcatcttcctggttgttggctagatgctgccctgaagtcctggaggctgctggcagttcctggccatgtggttctttccataggtggttcatgacatgactgcttactcaaggctggcaggaaagtctctccagtccactaagatggaatcttatctattgaaatcacagaagtgatatcttgtcacccttgccatattctattgattagaagcaaactacagctttcactcgcactcaaagggaggggtttataccagggtgggactccttgggggctaccttagggtgtgtccaccacaaataatgagaaatagaggcaaaagctgggacactgcattgctgtttttgtttgaatccttctgcttcattccacatcccctccacacagtgcctcattcacctttgtgtgccgggctcataacagaggtgtagtgccgggctcataacagaagtgtaatgcatggagggacagtgatccttctggaataggcttccttttgctcccctctctgaaggatgatgttggaggcaaacgggaaggagtaaaagagaaaacacttttcttgtgctgcctcccaaataaaacgccaaataatgacatctataaagttataagaaaacttcaaaatcataagaaaaatatcagtctcactgcttccatcacatgactggggagaatcatgctattagtgtctgaagagtttttaaaaaattatgaacaatattttttaattaacttgaatcaagaactcagtgaacatggtggtgacttttggtagctctgtaccatttttgaaaattcgttcatcaatgtagcttttagatgccaccatggccacagcatggaaagtgaggcagtccagcatatagtagtagagactgtccactgtacaaccccaggagtgctgtttacaaaaccacactgtctgtccctcccccggttattattcctagtaagaatattgtgcatattaatggggggacatttaacacaaaattccaactgagttttggggtcacccttagaagtttttggggcaggtatgttatcctaaccctacagatgaggaaactgaggttgaaaggtttatataacttgcctggtgtctaatagtgtaaggatcagggccagggctgggacccaagaccaaggattttcccacaaaattcccactttactcttcatagagctgggcttttgctttgttttgacttgtcctgtccacagctcttcttcaaataaatcagggtcatccacacagcccgtgaaggtggtttcccctacaggtgtcaaaagttctcaccctgtgatatggtttggctgtgtccccactcaaatctcatcttgaattgtagctcccatgatcttaacatgtcgtgggagggacctggtgggaggtgatttaatcatgggaatggttaccctcatgccgttctcgggatagtaagtaagttctcaggagatctgatggtttcatagagggcttttcctccttttgctcagcacttcttgctgccaccatgtgaagaaggatgtgtttgttaccccttccgccatgattgtaagtttcctgaggcctccttagtcatgctgaactgtgagtcaattaaacctctttccattataaattacccagtcacgggtatgtctttattagcagcatgagaatggactaatacatcctgttagaaattcttcaaccaaccctaatctacaaaacagtggttagaaaactgcattgccctctagcattgaagcatgtggttctacatgcccattaagtggtgacttgttcacctttgggtatctgtctcatagcagctgggtggacaataatctttctagaatgggcttccctttgctcccctttcaaaaggacactgagcttagaatttgccagctacctggcatcttgagcagaattcatgttttttagttcagcaaacatttattgggcccggtgttttaattgctgagctaagggaaagctaaggaaatgagggctttttaaatcctgtcatcagggattttaagttgccttctcaatctcctagagtatgatcatgctgtccccagtaccataatgattccatgctggacacatgattaattctgttagtagtggcaggctccactgtatcttcagggaacgtatttttctttttggcttttgctagtcaaatgtggttaaagaatcaatgatgggaatttaagagagttttttaaaaaaaaacacacattaggagagaaaaatatttggtcagcttttcaaagtggaaataaccatgggggaaagtgctgtagcaggtatttcctttgattttttttttgagcttatactgcatatgtactttagaagtagaaccagaaaggaaatgtgaacggaaattctttgtctagggtttatcacatgaatacgaaaagaatgacaaaaattatctatacgttgactgctgctctcttgaaatatctgcagttttcatttgattaccattgttagtctaatataatttaattgtatttaatagctggcaagatctgcattgagtataattacccattgttccagcatgatctgttagatttttgttcagcaaatattctttccccttgcccctttaccccaacacctccgtagaaggatatttctctaccctattgggtttggccgtgtgatcagcttggaccaatggaatgagggtagaagagatgtcttagttctgaggctaagtcttcagaagatcagctctctgggagcttctgacgtctgccatgagacatatgcccaggtagttgccactccttcagcctaagtcccagaataagatgtatgcagcacacttggattcaacctgccatctgaagcagaagccatgagcaagccatgaaaaagaaccgactgtcattgcatatgatgccactgagctttcatgtcagcatatttcatagctaatgtaacacacctaatgatagcatgcccacagatgttacaagaaaacggtgattaatcttctccagtacttctcagtcttgaagctccgtttagagtcacctggaggatttgtgaaacacagattcctgggtccaaccccagagagtgtaagtcaattggtctgggttgggacctcccccccaatttgcatttgtaacaagtttcttggtgctgctggtgctgctggtccaaggacccactttgagaatcactgatagaaatcactggatactaatgggattaaccattttcagcagatatgctgcacagatagaaatgattgagctctttagatatagctactttttgatatgatatgagctgagaacagaaccaactacttagaggaaatagaccacaatggagagaatacaaatagtactggtggtagagtggtggagtgggagaatcttgtaaaaatggattttggcctctgaaggagtggaatacaaggctctgaacacaataatctaggggagtagtccatgcagacccaggcactaagaggccagattggaggtggtggtacttcgactggtattttagtcttgttaacaaaacttttatttatgttctagtctggagacatggaagataggattggaaaacttgggcttattgggtcacttttaaaatacacaataaagaccatgaacatgggcatctttacattagcatgaaaaacgaacaacttaaggaatcatctggaagttttcaaacatctgcagacttggcctcatgttgatttgcctgaaaacaagcgtgtaattggaaatgggaagagacaagtctaaaacatttactgttggatcgtcttgagcattctgctgtcagtgtagatgaggtcccagcggcctgatgctgacgtatttattgatacaatgagaggcaggaagctgatcacagcttggccaggcacaattcccaggaaaaggagtaatgaaatcagatcacttatttgtaaagtacatccagctttgaattacatggattcccctgatagcctaaattagttatataaaatagaatattttatagaaatcacttgataggtagatggtcaatttgagttttgaattaatattagccttatttgtatttaccaataacctattttgaaaacagccgtcactgatccaacttaaacccccatctcctgaactctagaacattgcctctcaaactttgcagcttgttagatgtccaggccacactccagaccaagttcattagaatctctgggggcaggacccaggcattgggattttttacatcttctcagcagattgcaagaagtagccttgttggggtaccagtacttaacttgctattcagagtggtgcttgcattggcagtgttggcatctactgggagttggttagaaatgcagtctcaggctgggcgcggtggctcacgcctgtaatcccagccactttgggaggccaaagcgggtggatcacctgaggttgggagttcgagaccagcctgaccaacatggagaaaccccgtctctactaaatatacaaaattagccgggcgtggtgactcatgcctgtaatcccagctactcgggaggctgaggtaagagaatcgcttgaacctgggaggccagagtttgcagtgagccgagatcacgccattgcactccagcctgggcaacaagagtgaaactccatctcaaaaataaaaaataaataaataaaattgagaaaagcagtctcaagctcctccctggacctactgaatcagaatctactttgtaactaggtcccaggtgatttacttgcacattaaagtatggatagaagtcacacaggacagtggcaggtttccacccaccatgggccccagctctgtggaccctttcctaacttctaagcaaagtggatctctgtacctggcaaaaagcagagcactgattctcttgcctgtcctgtctcctctcttcatttactgagagaagattggaatttttcaaaggaacagaaagaaagaggagaggaagagggaagggtggagagaatgagaggaatagccaccaatacatatttctttcttctttttttatttttttattatttatttatttatttatttatttatttttttgagacggagtctcactctatcacccaggctggagtgcagtggcacaatcttggctcactgcaacctccgcctcctgggttcaagcatttctcctgcctcagcctcccgagtagctgggactacaggcccatgccaccaagcaaggctaatttttgtatatttagtagagacagggtttcaccatgttgggcagactggccttgaactcctgacctcaagtgatccgcccaccttggccttccaaagtgctgggattgcaggcatgagccaccgcacccagctaccaatacttatttcttattctaacttaaaacatgccacatcaagtcttgggcaacagagatcacagggaaactccagttcctttctaccatttcaaaaaccaggagaaaattaatctgcaggtggtgtttcttctaccccaggggttggcaacctttttttttataaagggccagatagtaaatatttttgtctttgtggccatatggtctctgtcacaactattcaactttgtcattgtagcatgaaaatagctgtagacaatactcaaaagaatgggcatggctgtgtttcattacaatttattttcaaagacaggcagtgattctactgctaggtacattctgaaaagaattgaacacaggtactcaacctaatctttgtgcacaaatgttcatggcagcactattcacaatagccaaaaagtataaacaacccaaatccatgaataaatgaatgaatgaatgaatgaataaacaaattatggtatatccatacaatggaatattattcagtcataaaaaggaataaagtactgatccatgctaaaatatggatgaacctcaaaatcattatgctaagttgaagaagccagatgttaaaggtcatgtattgtatgattccatttatatgaaatatccagaataggtaaatccatagaaacagattggtggttgtcaggagctagggggaggggaatggggagtaacagctcatagctatggagttttcctttggggtgatgaaaatgttttgaaactagaaagaggtggttgcacaacactgtgaatgtaataaataccactgaattgttcacttcaaaatggttccttttatattatgtaaattatactataataaaaaaaagttaacaaaacaaagcaaaacaaagccaggcagctgctagatttgacccagggagtcttagtttgctgactcctgctgtcctccattcagaccctgcttgatggttgatagactctccagctccaccaagatcctgtttccaagtcttctctgttaacagacattatatagccacatgctcaaactctacccagtcgctctcatttcatctctgtagctgcatggactcccttgggtcctggcctggtcctgactctccaagttgggaaggaggctccacatctactctaaagcgtcttccattgtgccttgtaggctttggaactgaccttgcagcagcctcctttctctccatgggctcttcatgccttaagcaccttccctagctagtgtgagacttggcacctctctttggttaagctcagcatcttcgtcccagccagcttttaggctttgactctgccagacttgatgacagacagacagacaatacatcctaattctcttggaatcagcacagtcataaactgacttcctatttttttttttatgacaagggggctctcacttagttcttgtttcttctccaaggaatgttagttcataggttgatcttaagacctattgatgcttggcctataccaagcacagtgaatggcccaagactaccctgtgtaagagtgatgagtctgctgaaataaaggatagtatcagccctgctaattctacctttgtgatctttgtgcaacatgtaacaccaggcctgaattttttttttttttttttttgtcactgaagagcacctgactctcttatgtatttcttctgttggtacctgaattaaattggttatacagtaataactgtataaatggtaaacctcgacactaatagaagtattatcaactaaagaattacctcaggaaagtactttatggttttatattaagattgtattctacatatcaggaaagtaatttatggttttatattaagattatattctacatatactaataatagacatactttaccaaacctgagagcaatgtccttctccctgtattagttaggataacactttagtctatgatgtgccaacaaataaaccttgaaatattagtgacaacacgataacattttcttgcatcacagactgatgcagatcaggacacgctctaccaaatgatgactcagggatctgaaatagttccatcttagtttttcacctggaacataatctaagtcttagattgttgcagtgacaaacccccagtgaattatgcctccttttaaattctttctcccatcaccttttctagtctcctccacatggattctttttactaaaatctattcctgtacctcatgaagagccctagctagtctgctggaggatgagaccgtatggagcagagataaaccctcctaagttctgaggccctcttgatcaacccattctttagtcaatcccagctttatacagccacatgagtaatcccaaacaaaatctatggaagaattgcccagctgagcccttctcaaagtgttaaactgcagaatcacaagcaaataaaatactgttgaccccggaacaacataggtttgaattgctcaggtccacttatacactgattttttttcaaccaaacatggattgaaaatacagaatttgagggatgtgaaccttcctatagggagggccggtgttttgtataggcagattctgcagtgctggctgaggtcttgattatgtggggatttgggtatatatggggttcctggaaccaatcccttgtgtataccaagacataactatagttgtttttgttttaagccactaacttttagagtgattattatgcaacagagatggacttatagacacagcctccaagaatttttatattcctagcaaggaagagaaggttaaagggtttcatgagatgtttttaaggactagaaggaaagtagcttccgtcactacttatcggattctatcggccagaacttagtcatatggccccatttaactgcaagggaggctgggaaatgtagacttcttgtatgcccaggaagaagatatagtgtggtgaaccctgcattagtctctgttgtacatccatactacctaccatagctgctcatatctgcttttctccatatcaacatcttacagccaacccccatgtgtaaataagcagaaagaagaaacaggccacattcaattcattttaggttgatcttttgttatgaggctgataaccagaataccataaaagccaatgctctgagaagaggaggagttatttggtgagatgagaagagattacagagatggagaggggactgtgatgatgtgctccaaaagctatttaataaaactccttcccttgaggggtaccattatactcaattcaaaacaaaacaactaatatttgtcaaacatttgttaagaggatggagccaactttgatacaccagaacaaacagaactatgtaagacaggttctgctttcaagaatgttttattctgatatgaagataagacacatacatgaataattgtaacacaaaatagagtttgagaaattgcatgagacaagcacacagtatttggaaggtggtgggagccaaaatacagaactatggtgtagttgcatgagtcaatgagaaaaggcttaataaaaggtgtcatattcaggtgagtcctgatgacatctgctaaacataatgacagataagttgtaagctttaaggtactggggaccattacacatccccttccctttagtagctgggacctctctggattccccaggagaacatagtagagacagagcacagtctggcttggggttgttactttgctgatccaatgatgcccctcagcatcattggaggaggtgatgcagtatctccagcccaactccaaggcataagtaattagcagcatgtcatagattcatccctatctaccatataacctgttttcatagccctccccaactctatcactctaacaacccacatcctgcatcctgccataagttgaggggttgcatctatgaagattggaagggtaagcctccaaattataattttaccctcaattcaacagttattgagggtcttctttgggctcttggaaatgagatatatgcattacctctccgtgtttacaaaacagagccccaaaaggatcctgacattcctgccaatttgtcttggaggataacatttggattcatatgtttcctatataataaccaccaagaatatacacattctaagagtcttatctcaaatgtttaaagaagatcgttctgagcacaggaagtcaatagagccttaaatataacaggatgtaggatgctttagggagcaaattaatcatcacaagaggactgacccaaagagatagaaggaaagaagaatctcgatcacataattttgagacttctactttacgttaagctgggtgcccccagttctgattgattgtcttttttgcacctctccaacatttctcagcttcttagtcccgtttctagtgcccaagtcaggaattagaatagaatttggaggttatcacctaactgtaccctcaatgttgctgtggtggtttcatcactcatcactaagagaatcttggaatctgaatccaattttcctgttataaaccaggagaagttgttactggtgcatttatggctttctggacattttttcacaggccctgaggatgttagcttactttaatgtaaaaatacttgttagtttgttcctcagtcactcatctgggtcatggagagaagatgggagaaccacagggctagaaggggacgttgtccactctcttagccaagtgaccatttcttcaaaaaaaaaaaaaaaatccaggtgtcccatatgggccagaagagcagctcagtttggaaatgagtagctggtggtaggcagacccagcctatttctacctggcttcatctcctgatgagatgcagaggaacaccatccagcctcccagttcaactgccaccaactttggaagaggagaccctcaactccctcatacccatgcatcccctaggattttctgagaatccccaaagattctcagaatctttgcatgcaaccacatgcaaccacaaggcagtctatctgctgcagtccccatgagcatctccaatttttcctctttggctctgcatctaacttattcattcattgctcagaaagccactggagacattttatagctggtatgaccacattttcagagacttgtgtctataccaccaaaggtatgatctccaggtgcttcccaaacttcaaattctctagagttgggtttattcagatgtgaggagaagggataaaattatagatttttaaggccaaaggaggccttaattcagttcaattcacagcaaggaaatttaatgaagttcaataatgtggactaaatgggtgttagaagatataggcaggaataagaccctcaaattccccttacatgagtgtgcctgcccaagggcttgcctagcttactgcctgtatatggtgctgctgagctttccttgtcattttttcctgtgggaggtggagcatgatgttggttctcttcccgtaagtggcacaatgtgatagcactgaggaatcacagtctcatttcttgatgaaggcatcttgcttatattaatttcaaagcctcatgaggtcagtgtcgaaaattctctaaaaaaaaaaaaaaaaaatcagttaaccacaattcagacctggcgtttcctaatattggtatcaggaaatactaatagaaataaatctgtacaaaattgctctccactcaacaccaaagcttctatcttaataattattataccattcagtttttccattaacttcctgcccaccttcccaacaaccttaaaaaaatacttcttggttcctttagtaagagaaaattttattttatttgcaaaagtgacagacacatagacatatttactgtaaactattttaaaagttttttaattcagataaaacaatgcacaggaaacacatattcactgaagagctgaagtcaacacattgaagagaaacattgtgaaagaggctggtttgaggttcagattacagacttgctgcccgtggtttgaagttctaagatggaaaactgaaggcccctatgctttcacatgtcatgatttctccatcattattataatttattattgtattaaaatactaacagaaaaagtaaagccttttttctggatagtgaagccctgcccaacttggtcccacagcacagttgctggtgcaaggctgaggagataaaggagattagcctgtcacttcaggaaaacagtacatggacacacagaaaatggataatgttagcatcttttccaaacagtttgcatcaaagaacatccattgggaaggaaggatgaaaatgattactactggaagccaatttaattttatttagtttgtttgtaatggagaggggttgtttgaaaaaggaggtttaaaggaaaagaggtggtaaaattatagaaagactaagctgaaaaagaacttgctgaggtttagcaaatttccttaatttaatccatgttcaactcaattgaataaaatcaacaaacattcactaagtctactatatatcagccctggggatgcaatgataagacccagtttgccttcaaatatctcagtccttgggcgaagagactcaacctggaaatctgaagtgacttatataagttttacagctagtcagtggtaaaagccaaactaatgtcccagcctcatgactcttggttcagcaatctgacacccaaactatgtttttttatagcaagtcagagaaaaacactggtaaactcatccaagtattcagatatttcatctatgcaatgcttaaaagaaaccagctaaatgttcttcaagatactaaatatgagaggtgagattctataaaaagggagaagaaggatgaaggtaataacaatacctaaaaagttttgtggatttagacattggtgtcagttgtatgtgataatcactgaatttcctgacttgaaggagttatagtctcagtaatagttacagtaattataacagtaaacatcatataaggagataatacttcttgtgtgcatactatatatcagtgactgtagtaaaaggaatgacttaaataaatcatttaagtttaaaaataaaaaaataaggtgttataattatctccatgtaagaattagctctagccacacttcatgttgcataacaaatcttcccaaaacatgatggcttataacaactgtttattatggctcttaagtgtttggtcaggcagtggttctgctgatcttggctgggcttgcttatgcatctgcagtcagctacctgggcagtagatgtaggatggcctcatctggggtgactctactacatgtaggccctcctccacatatctcttacatccctccagcaggctagctcagacattttgccttgtagagggaggaatgcaagaacaagcaataggacaagaaaaaatacacaagtactttttaagcccactacatcctgctttctcaaagtcaagggaagaattgggatgatcattgcatcatctaccacagaggttaagtaacttattcttttagttaggatttcggttagactgtgtgtaatagaagtccaaagtaacagtggaatattactacaccatatagtagtccacaggtaggcagtccagtcttatatgcttgctgtgctcgacaaatcctccaggtgcctgggccctttttgtctcattgctccgccttgctctcaagtggtgttctcatctgcatggcctaagattggccataactccaacaatgttccaaagcgaagatggagatcagggaggtaataaaagcatgcacctcgtcttccttaagaacatgagtagaaatctcagaatttccacttctggtgatgtgaactaggtaataaggaccaatcctcccagtaaatgcagcttaaaaagctatttggattatttttaaaatcttctaaaaagatcaaagagctaataagatactaagcaattattgggctgacatcttagacaggctgggaacccagaaaaaaatgagcaaagacttgaaactgcctttgccttaagggcatcttcagctgagatgtttagctgtcttctggtgaccccaagggattaggggaataaatatataaatgctctttaggctggaatccaaaggactgtgccctagaagtaaaggtaaatggaaagtaaactaactcttgcatcacctgaagccctgctttgtaaaaacctgattttccatcagaaaatctcaaatctgaaacgtggatcaagatggtactaaactgcaagcactggtctcagacacttaacagacatgaacataactaagaaaatgtcaccttagtcttcaaattatttctataaataatatttctaatattatgtccaggacacaatcaaaggcaactggacacacaagtagacaagaccatataagcaagaaccaacaaaaacaacagacaatagaaatacacctgcagactataatgattggaatagtcagatacagactgcaaaacaacaaagatcaccatgttgtagaatataaaaacaaattttaagtaaattggcagggaactggaaaatataaaaatcaacacagcaattttgtaaaagtgccaaatagaaactttagatctgaaaaatataacaatagaaaataacaaaattaacagcagattcagagtaagctaaaagaaatagttcaaaatgaagcacagaaagccaaataataaaatatttagaatggcagggagacagagatagtgataaagtttaatatctgtttaattggaatctcagaaatagaaaagagaaagagagattgggagataagaaattctgaagagatgaaggctgagaagttttcagaaatgatgaaagacattaatacacagaagccactggatcccaagcaagttaaaaaaaaatccacatataaatacaccctagtaaatatcagaaaaaattaataaatcatattacttttgttgtaattggccagatcttggtcatataggtacagctacctgcaggagaagttgggaaatgtagtttttattctatgatttattcagagctatatgcgccaacaaatattgagaatgttattaccgtaagtgagaagtgaagcagtgacattgacattgataactttctaaggtcacacaactaataagtggcagattggatatttgagtcatcatggcctgactccacagcttgtgctgtcagccactatgctatacgtgtgtgtagaagactatgtgtggtccaaggttcaagttttcaaccattgatcagaaattaccatagtgtattgattaagcaaaaagtttatataaagcacattagcaacaagataaccacaccagggtcataaaaacactagctcatgctagtagaaagctatttcttctcaaacattttaatgttgtttgtggtcattaagaatacactactaccaatcacgcaaggtctgaaagtgcacaataggctggaaacatgccaatttcaggagggttaaatttgcattgataactttaggcatctgactaatttctatgggtgcaatgaacaagcttttagtctcttcacaagttaactttttaggctgcaaaatgaaagttccaagaatgaaagtagtaggagaagggatgaaaaattgattcttgtctttcaacatctaaagtctttttttttttcccaaatgtgacctcaggtgcataccaaatacaattgggcattttgttaagtaactctaagccagggcccatagaaaacctatggcccatgggccaaatccctcttgccatctattaatatttttgttaataaggttttattggtgcacaaccacaggtcttcatttatatattttctatgtcttcttttgccctaaagtggaagaattgagaaattgtgacagaaaccacatgacttacgaaacctaaagtactgactttctggtccttctcagaaaaaaagttggctgatccctgctctaagccaatggtgatttcagcatactggggaagataaattcatcttcatattcagcctcattatgaaggaatatatgaggtctcttatctcctcttggccttctttattttcaggtgggatattttttagtatgtgaaaccacctcatgtttagtgaaccccatgagttgaacttgacaattttggatgtggtatttaataaacaagcatttaataaactctcagtttctagtttgcttactttttattgaattaaatcattttcaaattgaatttggtcaagcagcttgataagtgtaggcaaaacaaaactttcctatacaacaaaaactcggtcccctaaaaggtcttttggtataggtttctcaaaagaaagggtgtcgttttctctgcaagggatgattgaacaccaaagatatgtttttctaaggtcagaccataaggaatcataaaatcaatatttctaacatttatggatttgatctcattagtttttggcaatacatgacttcttgatttttgaaagaggtttacaaaatggtgcagaaagcttctgggacatgaataaaatatagatttttttataattttagtgtaaacaaattccaaacatatggattagatttccttttaaaaataaagcgttttagtatttaatgggaaaagcgatttgcaaaatatgctttggattttgtcaaaaccaaatcattcaaaatgtgcaattaactctaaatgaaaccaaattcaactgtccctggtttaaatgactgaaaaagacatctctcattgctgttcatgccttttggttcccaagtcttgaaagggaagtcagaatgtgctgtgaaatgtactgttctccataaagtcatgcagcaaaatgtagttttgcagaaagtgtttcccaggggaatatgtgcgaccttctcaagtgtaaatctattttgactagttatgatgcttaagaagaattatagagaggaactgacgtgtttcctggtatggaatcaagtcgttaatttccactggctatgaaatacttatttttgtcctgagaactaaataatctgacaaaagccttctacatgttaatgaccttttgtatttgtaatgagagcagtacagtggtaataaatgcaccgttaaaaaatacattaggttttttaaggttttctcttagatcacattcatttgcagaaacaaacattgctgttttaaaaccaagtgggactgactaactgattgttaggattatacaccaaggaatactttcctagttgcaatttgcagtttttctcagtcgtagaaatcaaactgatagtggagtaggcacaaacccagactgggagccttgtatcaatgagtctgtgctctgctcttaacataatacatgggcctccttagtggaaacataacattatgaattaggagtgttttggaatatgcaagtaattctcatgcgaatttaaattttaaatgaaagttatggtaggagaagatctataagccatttgcaaagaattgaagatggtaataaaattgaagagtacattatagtgatgcaaataaatttttagttctggcagaacagggaaacaaaagggcattatttaaatattgaaatctaggagcataattagaacagatgcaagcccactatatacacagaagaaaaaacaatataaataaatactcgtgagagagaggaggaaaatgatagaaaaataaaaagagggaaataaatgaacactgcttgtttccctgccagccttgtataacatattaaagcattcattttattgtctctcaaagcatttcatttttcaaagaaccatccaggaaaggggaattttatatttttgtatcaatttctccaactctttcatgccacaaaaagggcacagtaatagcgaaacatgtaaatctggcatctcaaaggtcaacttctttcatgtttcaataacattcttattgtattagcacttttagattagcacttttaacacttcttcatgctagatgtcaatttttaaattgcatgtttcttacaaacatcacccaagtccatttatatttaggttttatattttcagttctcacccaaactgatctaaatgcaaaacgtacactcttgacagagcaaggggcaatcatcaccactgttccttgtgaatcaaaagcttttgcagttcaagggattggtcccagcagtcacatcattatttcttgagttgcccattatgtggttaaaatttacataaatattaggcatactcagtcccttccctgtggcttttccagaaggaccacattcctgtatatttataagcagctttcaaagcttcttgttataacttgcagaaaagagaaagtcagaaatataaagaagtcttagatttatatagatcagtgctgtgttaacagaatcttaggaagatttcataagttcataaccgaactctagaaggcagttgggatgacagtagccttctgtatctctctttctggaaaatattgtagattttccccctctctggtcattatatacttcttcccctctgcctttacttttgggagttactttccctcctgatattatctggcacatgacaccttgccaccttccatcagagctctctacttctctaactttgtctcttaaacttccctcttggtttccctctgttttcattttatcaggactcactgcttatttctgctgcctagtttattcccccatttctgctgcttgcagggttatcaacaaaaaatttcactaaactgcttccatttcttcttgggccaatgggaagcctcttgcatggagcaggccatgggctgatgtctgcatgacagatttgtggtcatggtgctgtagccccttccagacctggcctcttgaaagtcccacaacatcttctacctccaccctcccttcatgtagagaccagtcagagaggattcagcagtgtggctcaaggctctccaggattctgaggatgtagaggttagtggaaccacaaaatagaaggagcctggttgaaagagatctggccaggagagctatgtgatgaggacatctgcactggactctgtgtctgcacaaaaaccttcactgtgttaagccactgagatttcaggctgtttgttctaacagtttgctgcactatcacagtcatctctctatgactttcaagacccctctcaataatcatctcctccatggaggcttccttcctatgggcttccagagcaccttgctttactataagggtacacagttttttcaatcctatgagttgaaacaaatattttacctcttgctctcctaccttgaagatagcaactttgtattctagcgctcactgctgtgtctggcacagaacaaaaagatgctcaacaaatctcaatggatttcctcccttcctgaaaagaatgcatcacacatgggagaatttcaggccctgtagcccttggggatggagggggtttgggtgataattgaaggtgtgtgtgtatgtggtggggtggtcagccgtgtgtgtgtgtgtgtgtgtgtgtgtgtgtgtgtgtgtgtgatggggtggtcagccatgtgtccctcaacataatcaccttctctgtttattacacaaggaatactttgtcatcattcactttctagggagtatgaaggcaagtttatataatagaatgactgtgcttacataataattcattcaacaagtatttatctttgctcagacactgttcttgatactaagggaaaaggagtgaagatgacagactagatccctgtcctctagggctggcttcctgggtaaacaactcaatggtgagattttactatgattatgaggttttgctcccatttctgcaaatccttgcccaccccatttgtttctcaggtatgtgtttccattctgttcttgctctagattccttggtttctctccctttggatgggaattcttaactgaggcaatatgacccaacaggaaacgtttggcaatgattagagacacttttggttgtagcgagtgaggaaaggggtgcttctggatgctgctacacttcttacaaagcatggggcatcccctctgcctgttccagtcccttcagcctggaggagggccagggctcttcaccactgactggaaagtcatcctttgggttctaaagaactgccttctaggcagtgccaccaacaagaccattcccttctgggcagccaaataatgatttctttttatggtgcttcttgattctttaatatacaccttagcccagcagcaaaggataggaccacgtatgagttatactgtcttagtctgttttgtgttgctataaaagaatatctgagactgggttatttataaagaaaagaggtttatttagctcacaattccacatactgagaagttcaaggacgtggctctggcttctggtgagggctttgtttttttttttttttgcagtgtcacaacatgacagagaaggtcaaaaaggaagtagacatgtacaaagaggggaaaacctgatgggcatcctggctttatgatgacccattgtcctggtaattagttcacacccatgagaactaatctagccttaggagaatgaaagctcactcaccattttgagactggcaccaagccattcacgagggatccacccctatgacccaaatacttcccatgaggcccagcttccaacgccactacactggggatcaaattttaacatgacttttagtggggacaaacaaaccatatccaaactatagcatatacttaaccctccatcctagttcacaacatctagaacagtagacctttgggtacccatttctagacagaaagccaatcacaaacacacagagagggtggcaagaaaaagtattcactttttaaatgagtggctttgtagttaaggttataagataaaatgcagacccccacttaaatttgaatttcacgtaaacaataaatagttttctagtgtatgtcccatttaattgtaggatgctagcaatgccataaggcaatacttgagacatatgttgtaagttattcattattagaaattattatccattattagaaattcaaatttacctggacatcctgtttttgttgttgtcatttctgagtgtgtggttttgtttcttggctaaatctggcaactctattttccatacattcaaggtagcatcagatatgcatctctgagttccttctccctctggtggctccttcccacttttctcttccttgcctgtgactttctcacccctcctttgaagacaagtgcaaactgtttccttgcatcactctcggacactcccctgagtaacttacacatttttaaaaacctctttccaccaaaagtagataagaatgaggagtggttgtgaggtaggcattggaaacctcattctgaaaaacactacattaggaaaatgaaatggattgaaactgaaagcaaacatgttactatttgaatcaaagctgattcttagaaagttctgttctacaacaaatatgaataagaaaataattgaattcttcataccattcctttgtatataaaactgtccttgggcatgcagtatctgatttaatttactaattgaattatataatttctcaaaaatatgcactcaaagaaataagtgtggacgaaaagatgggaaaaggaaatctggggaaagtaaaaatttttttttccattttcttttttttaatgttaatattattatactttaacttttagggtacatgtgcacaacgtgcaggtttgttacatatgtatacatgtgccatgtttgtgtgctgcacccattaactcgtcatttagctttaggtatatctcctaatgctattcctcccccctccccctaccccacaacagtccccagtgtgtgatgttccccttcctgtgtccatgtgtctcattgttcacttcccacctatgaatgagaacatgtggtgtttggttttttgtccttgtgatagtttactgagaatgatgatgtccagtttcatccatgtccctacaaaggacatgaactcatcattttttatggctgcatagtattccatggtgtatatgtgccacattttcttaatccagtctatcgttgttggacatttaggttggttccaagtctttgctattgtgaatagtgccgcaataaacatacgtgtgcatgtgtctttatagcagcatgatttataatcctttgagtatacacccagtaatgggatggctgggtcaaatggtatttctagttctagatccctgaggaatcaccacattgacttccacaatggttgaactagttgacagtcccaccaacagtgtaaaagtgttcctatttctccacatcctctccagcacctgttgtttcctgacttttgaatgatcgccattctaactggtgtgagatggtatctcattgtggttttgatttgcgtttctctgatggccagtgatgaagagcattttttcatgtgtcttttggctgcataaatgtcttcttttgagaagtgtctgttcatatccttggcccactttttgatggggttgtttgttttttttcttgtaaatttgttggagttcattgtagattctggatattagccctttgtcagatgagtaggtcgcaaaactgttctcacattctgtaggttgccttttcactctgatggtagtttcttttgctgtgcagaagctcttgagtttaattagatcccatttgtcaattttggcttttgttgccattgcttttggtgttttagatatgaagtccttgcccatggctatgtcctgaatggtattgcctaggttttcttctagggtttttatggttttaggtctaacattaataaatggtgctggaaaaactggctagccatatgtagaaagctgaaactggatcccttccttacaccttttacaaaaattaattcaagaaagtaaaaatttttatagcaaaaaagaagtcttgagcagtagatgccacaaagaaagcttggtactgtacttgaagggaattatttgtaagaagtataaaatgaatttagaggaatctgcaatgtttttctttcaaatgaatgtaaataggtcattgcattcaataaatgtttgttgaactgaattaaagagtctccatcttcaaggaggattaaaaaaagaaatttcaacaaaactttaaggaacattaaaagaggaaaaacaatacaggtgggaaaattaaattataagacttgtgcaacccctgtaactagacaataatgtccttacaaatgaactgtagcagatataataccggcaataggggagggtatctttgaataggtacaagcaattagtattagatgttgagaataaaaagagattggagggaagctgccaagcatgtcttcatgaaagatttgggactagaattgagcctagaaggatggacaagaagaagaagaagggcattttggataagaaagccacacttgcagtgggacaaagatgggattttgctacagtggtgagactaggcaaattgtcatgggcggtttagacaagagaacaatcaggtgaaatttaaagatagataaggggcagactgtgaatggactagatcccaaggctaaaacttagggctacttatcacttaaatacagattcagaccaggttggaatgtttgacacccactgaaaaaaacccaattttttaaaaacaaatgatttcctcaaatcagtcccagataagatgggaaacaagatgatatgggatttggtggaaatctagagaggcagaattggcttgttaatggcagctgtttcaacaattagaattaagttcagcacaatgattcaatttagtttaagaaaatcatgtcttacatttcatctttcaatagtttccactcctccagtgagccaggagagtttggttttggtataaatcactgccaatcttgtttagtcaacattaagacaacaaaccagaaggagaatggccactcttgctctcctgataaaataatcaagtgactaatgacttaatcccaagcaactggaagaaggaggacacggctgactcatccattgaaactggtaatttttattgttgggctaaaccttctttcccaaataggtcaacattttgaaatctcattaaaacaaacaaaatccctctttcagttaactccatctctctgaaagttttgttttataaaaaggctgttttattgtacaggtggattttattctatagatgcttgcgctggagcagaggaacccctgtctctttgttgtctgttagagacaaaggaccgctgctgacacagtgatctatgatgcagcaatggattagagccggtattctctagtcacaggtgttttcacagagacaaggtttttggtctaaaagcatctttgttctcagatttaccttctgggttcctttaaagaaaacctgctttatgaaacaaaagcaaagacattggcagataagggtctgataccatcttcagaaccatgaaatgactagagtaggaaaaatgggatacattattttgatcgtcaccgaaggatttgagctttggctaagagttctttgtctacttttttgggtgaatttggggaaaaccaaagtcccttggttcttgtatttccattactgttggaaatgttcagatgcaaaggctcattctctcagataaatgatagaatggctttagggggccaagccccatgtgctgagctgcaggcaagggtggagctgaggaatcaatgacagatgattctgtcaataaagttcaagacagtgtggcattctttttgtggtggactcaatttattaatagaactttttgttgttttgttgttggtggtggtgttcctggggatggaatgaaatttagagctctgtttgaaaaagttgtcttcaacttgctcaaaaatagatcaggaagattaagaagagaaacagaatgtaaatctacacatacaaagagcaataaaaatgaaaccagtcatcttttctgtgatattgtgaaatacacatttggtctttgttttgtttccttacgtacaactcttaaaaccctaaaaatctccagagtgatgagtgtcttttgtaggctaattagatgactgatggccggggtcccctaaatagcttcaggctgggggctggtcacaggaaaggtcagcatgactggagggttggaactttcagccccacccctcaacctgggaggatgtaggagcaataggagggagaggggctgaaattgagttgattaccaatgcccaacgatttaatcaatcatgccaacataataaagcttccataaaaatccaaaaggactggctcaggcagggtaagtgaacacatctgcatgctgggagggtggcacaccccagctccatggggacagaaccctttcagaccttgccctatgtatctcttcatctgactattcgtctgtgtcctttattaataaactggtaaatgtaactagtagtttctcgagttctgtgagctgttctagcaaattaatcaagcccaaggaaggggttatgggagcctccatttatagctggtaggtcaaaagtccaggctacaacctgtgtgtgctactggcatctgaagtggggcacaatcttgtgggactgtgggatctgatgctatctctaggtagatcatgtcgaaattgaatcaaattagaggatacctaactggtgtccattggagatttggctgaaaaattgctttgagtgtggggtaaaaaaaccccatacttctggtgtcagaagtgctgagtgactatgtgagagtggagagagggaagaacgctttgttttttcctatattactacatttacaaatgtaactaatctcttttcagagttggattcaattttttttccattagaaaaaaaaggaaaacccaaatttttgaaaaagttattttttccaaaataaaagaaaatagtcaaaagagaacatttcaacttaatatgatggaattgatattctggaatttccaaggctagaacacaagaagccttgccaagttgtcttaaaactcttgctctgagggaagaatgccaccatgtgaggaagcctaagctagccacacggggaaactgcatggagagagatgcctgaccaaccccagcaatcccagccatcccagacaccacacatatgagtgcaaaggcttcagatgaccccagcctcaagatcaacagacagctaccatctgagactctgagcaagaaccatcagctgaacctagtccatccacagaaccacagggataataatacatgcttttaaacccactaagtgttggagtggtttttcatgcagcaatagataattggagcagtccttgaaaataacttcaaaacatggacttggtggtaaccagagaaggtgatacagaggtggccgtgaggcacagctttgctgccagacttcctggagttgactctatgggttcaaatcctgacccccccacatttggtaattagttgccctctcaaaacatcagcttccttgtggggggggggggggtggcgggcggggggagggccagcattaggagatatacataatgttaaatgacgagttaatgggtgcagcacaccaacatgacacatgtatacatatgtaacaaacctgcacgttgtgcacatgtaccctagaacttaaagtataataaaaacagaacaaaaaacaaacaaacatcagcttcttatttgtaaagtgtgaatcatgataataatagtctctttgaatggtggtcgcaaggtgcaaagaaattcatgtaaagtggctaatattaaagggtaagcgctaaacacatttcatgtgtttttattattaactaaactggcccatagaaagtcaaaggctttggagagaaaacagtttgtttacttatttagataagaggttcctgtattcggacaatttattctgttgtttctagtgggctgacagatgctgtaaaagaatcacctctaagacgggaaacgtggaaaaggagtaagcacatccaaagaccatttttgggaaatgatgtactctgccttacatgggtgaaaagcttaatgtttcttttgaaaactgaccaacagagaagcaaatacagaaatgagtcttaaggcatctgtggcaaagttaactccactgggtgctggataatgtatactgtacattcccggaatggtgctgcctagaaaatttattatgtgtaacatttaataaagggaagagcttaacaaaacaccctggagacctgcgttctaattgagtatctgctttgatgtctgactcagggcaagtcagtggagctctgtctcttatttctaactactataaaacagaattatgagcacatttggagcacccccagacactaaaaaataaaggcggggggcagagcatctgaaaacatggatacataaaagagaatggccagaaggtatgcatgataatgctgttagcatcaggacaatgtagagtccctctgggcttcagcagggtcagactggggaaagaacatgatgatgtcctagaggcatggacacctttccagcctgtcacttagtgatatcagaatgttcatatctgcagaatgaagtggtatatatggtatatgccatgtgattcatataccacataaatggcatataccatttggtccatacaccatatccaggcatatggacactggggtatcatttagaaaactccaattgaaatcataccaacctggctttgatcaaattcaagcctttcaaatcattggagcctgtggttgacaccttctatatgtctttgaaaatttcactccgtaatatgttaagagactggagaatttgccaatccctgggaaggacatgtctattggatataataatgagaaggtgtcaactgcagagaccattagtcatgtttcacagggagggctcccttccactttgacacaactgtcattctgaacattgcaaatgtttacttttctctagtatttgtatttagattcttatcttctatctcttggtttgttgtctaagtcaccttgttagcatcataattcttcccaagtttggcacattcttttgtagagttctaagaagcacccctctcccgaaatcatatgtgaatttagaggaccccagatcagctgatgtggagctggagtaaataaaaggcactttcatttaaatatcttatggagaaagtcattggaaccccaagtggcctctgagactattaaataaacccagaaactggaaggtcaccgaaggcaggtctaagtgcttcgtgttgttcactgcagaaactccagcacccaggatagtgcccggcatacagtacctgctccgttaatacttgttgaaaggatggtgacttaaaagaggtgttaggccagagaagcagcagtttggtggcaggtggagatgttaagggtgtgtgaacatccaaggatcttatttcagaaacaacaaaggaccaaagaagacaagacaggagcttccacagggtctctgccttggcctttgggatagggaagggagaccctaaagcaaagaaattatgtggacagactgctggagaactgcctggtaaatgttctggtgttttgaaaagagagtttcaacctgaagtaaagaaagaaagagtattgcttcttctgaaaaaggagcagttcccaggatgaccttgggtgtgggagcccatgacctcccatgactgatatatgttacactgagcccaatgggaaaacaagacccctctgagtctccacagagcagtaaaggagtctttgtttcctaaatgattgacttagaatgcaagctaggaatggaatttactaataagagaagacaggcagaggacatcattgctgggccacacttgtttgggattgcagaaccttatcatgcaaaaagtgtgaggctctttatatgggtttcaaaataccatcaccacatcagatgctcaataaactgtgataatgtaaatgagttacctaatagtctagtctaagagttggcaaactttttctgtaaaagctcaggttgtacatattttcagctttatgggtttcacagtctctgttgtcactgctcaactctgcattgcagcatgaaagcaaccattgatgacccataaaagaattaagcgaggctgtgttccaataaaattttatttataaaaacagacagtggcccagatttagtctgtgggctggagtttgctgacctgtggtctagactcttgctattcaaagggtgctccatggaccagttgttctagcatcacctgggagcttcttagaaatgcagaaacccaaactgggcatggtggctcacacctgtaatcccagcattttgggaggccaagacgggtggatcccttgaggtcaggagtttgagaccagcctggccaacaaggcgaaaccccgtctctactaaccgtacaaaaattagctgggcatggtggtgcacacctgtagtcccagctacttaggggactgaggcacgagaattgcttgaactggggaggcagaagttgcagtgagccgagatggtgccactgcactccagcctggatgacagaatgtcaaaaaaaaaaaaaaaagagagagagaagaaagtaagagagagagaaagaaagaaaagaaagaagaaagaaagaaaagaaaagaaaaaaaaagaaaagagaaaaagtaatacagaatctgagacctcctgaagcgaatctgaatttgaacaggacccagatgatgcatgggcacattaaagtttgagctgcgctgagctgaatagcgtagggtttcataaggaaacgattccattttcctcccatcaggtccctcaaatctactgtggtgggtctatttttcccatccttgtcctaccggatcttcaacaagcccctatttttttgttgttgttgtttctcctgggcattagaaatgtctcatttttagctattaataagtccagtccaatctacactgatatttttgtattaaatgcaattcaaaggttctcggctttcccattgcttagctgcatcttgtggaaacctcagtgaagcaaaggggcagggtgtgttttcctcatttccatcttccacctttctcctctctggcggcctgcagcttctgcctcctccacagcagccagctgtgtgaaggaggagagatcagggcgcaaagctttctatttgtcttgtgcttttacaggtggggtgtgggcccctttggggcagctgtccaaaagctggctctttctcatgtaggatgctcctgtgggatgtgagagatcagactcctgtgggacatcagaatcttctcagcttcccaactccagccatgctctctctagcttccctctgaccatgtgtccctcatgactattttgtgttggggtcacctggctctggcaggcatgtcttcgggcaggtcacactagcccatccaccttcagcattactctcttagcctcagacaaagtcagcccctttacctggcaagctttggtggtgcgggctgtgacgatcccagcttctgagttctcttggccatcattggtaagagcagccagtacttcatctttaaacttgctcagacaagagtcaggccccagtctctatggcccaatgctgggacacggggaggatcagaggtccctgaggctgccttgtacccctgcaggaggtagaggacgcactcaacactctcctgaaaaggaggagaacaaactcacgactgttctttcctccgttcatgccaaagtctttcctctgtgcccgggctcccctcatatacagacagctagtaagtgatgagtcagggtcacagagtcaatttcaagtcacttagcaaatctttcatggagagtctagtgtcatctattgtctttagctttgggtcccagccaaagttccagacagggaaattcccatacaacagctggtgaaagtaaattcactccagtcgctgtatgcttaggagaactttggcgcatagataagtgactggcacaggttcactcaactagtaaggggagagctgatgatctaaacccctgactccaaggctgggctcttccccttccaaaacttatcttacagacaatttcttccaatctttctgattgcttcaaagaagcaaacgaagccagagttaaaactgaagttacttgattttcagctaagtaactttgccattacaccacctttctactttttgtggagcagaagatcgagcaactctacagcaatcagataaataagagggaaattttaaaattcaatcacttaggaaaattctgccttttacatattttctgcattgagaaaccagggctaaattgacaggaaaaaacattcgctgtatgaaagaagcaagtctcctaacagaatatgttaaatgaacccagctttgttttaaaaatatactcacatgcatataaaagtgcctggaatagtacatcatgtgttaccagttctcgttggtttctaggaggtagtttataagcttttctatattttgacctatttcgtgttcttccatagtgttggaggtttattctaatgctcgtgatttttataatatggaataaggcacatatttattttgacaaaatatagaaaggaaagctatttggttttagcttttgttcctatcaattttccattatgcgtaatttcagtgtcaatttataaaaggagagcaataaccagccttcagaattttggtaagtcctcctcttacctggaatctatagaaaaagacaactgtgaatttgatgaaatatgattttcagggaaatggatgatttcagaaaaaatgatttaccagaaacaaacaaacaagcagcaacaacaagaaaacacaacacttcagagagagaagatccttggtgtgtttaggtaatttagtgtttgtgttgattctgtgattggcagcggtttaggattagaatcttctatgtataaaatgaagcaggcagaagagtgacctgccttcacctttgatctgcagaggtcaaggtttagactaggaggtttgttgattctcctgcagcatttatttcttggtttcctgatggccagtttgaaaaccacgaactcagccacaaacccacaaactcaattcaaagtgccatactgaatgcttttaggtgatcattcagcttggtcactataatcccgagatgggtgaatgcacctcctccacaaagctgctactgctagcactcaacctcccatccaaataggaagtggtttccctttcctttaggattcctcttcacacacgtggctatttatttgtgtgtcttacctcccctgtgatgtaaacttgagtttaatgactatgtgttattaattattggattctccaaatagcacaggatctggcataaaacacacactcagtagcctttctttagcaatgtagttactatttttctgccagccatgcaggcacacagtttagacggttgtatggttccacaggcttgatttgaaaagcagcactcccctccccatctccccacagcttgttttctattgcccacaggccactcccctaactgactattttgaaatccatcttcatgcttctaggtaacatgcttatatcaccacttcctcattttcccctttgtgcattatccatcagcttcccattttgaaggttgaggatagagctctcttcatgtcaccgcctcactgcccccaccacccacacacgtacctcctgtcctcccatcctcgaatatagtcattctgtaactacagtcagatcatcattcagactgtatgatcgtgagaaggcaatgctgttgacaatcgagcccgcccaactgttctctctctggagatggaaatggtctttttgttttcctagttggcttagttttctatgcacatatcagatgtgttctcaaacactaccctggctacctatctctcttctcatcatattcaaacacattgggagttctatccatttcatcttcttgggaaaatgtctcccaaagcttcagccagctttgtccctccaccaccctgatgtatcccttcctcaatgttgttgtgattttctcagcccctggccctggatctcctatttcctctccttctttcccatttactctttgttaggtagagtgcatcccctgattgattcctgggaataagtgcatgggttgtaaattttttgaaacatctcatggctgaaaatgtctttgctatttatccatagctttgtcttggtatggagtgccatgctggctgttatttccttcagaaatttgaaggcattactttagtttcttttagctctgctgttgctattgaaacatccaatgccattctgattcctgatcctttgaatggaattgttgccccctcccaccttcactctgaatactttgatgatcttctctttttttgttttttgagacggagtttcactctgtccccaggctggagtgcagtggcaccatctcggctcactgcaacctccaccgcctcccgggttcaagcaattcccctgcctcagcctcccgagtagctgggactacaagtacgcaccaccatgcccagctaatttttgtgtttttagtagagacgaggtttcactatgttggccaggatggtctcgatctcttgaccttgtgatccacccacctcggccttccaaagtgctgggattacaggcatgagccactgcacccggccgatgatcttctcttggtgcttaatggtcttgcatttcatgatgagatatctttgtgtgtatctgtggtcaagcgttgtactagatgaactgtggggaatgctttcaaattgaaaaaccattcctctcatttctgggaaattttcttggtttacttatttgataatttccaactccctgttttaactgctctatactttgcagcccctgttttttgaattttgtgtctctggactgtcctctcccttaaaaaatatttgttttcttctcctattttccttatctttatctttcaaggctacctcatgacagatttcctcaactatccttccaatacatcaagtctttcatttctgctattacattttttattcctaatggctgttatttttattctccaagtgttccctttttcacagcatctgtccttatttcatgcatgtgatatcatctgttatttctccaaggatattaatatcttttgaacttttcttcttgcatagcatctttttgctccaaattgctttcgtaaggttctcttttatattacatgtcacctccctcacacgtttggcaatccttgagtgcttgtgtgtaagaatggggcactaaaactgacaggaagctctgaacacatgggtggagtagttttctgtgggcttccctctagagagatacggttggcctgtttcattgggaaccttctgatgtcagtctctcagatgtatttctctcaagctggtaggattcctctgagaggactcccaccctcctatctggtagaagtatgctaaggtaccagcattgtgggagctgagtggaggaagctggcagaagtagtgttggtgtctcagtatgtataagacatgtatttattaatttcactcttttcaatatggaatcctctccctaacctagagtttctgaaccttagcactactgaccttttggacggcatgacagctgtgtgtggctgtgctgtgcatcagaatgctaccaatatccctggcccctactcactagatgccagtagcattcattaccccagttgtgacagccaaaattgtctgcagacattggcaaatgttccctgtggagtaaactcaccctgggtggagaagcactgccctaactccaccgtgtgtttccaagacgagaggctctctgtttgtccctttcctaagaataaacatctgtttctcttctgggtttggtggacattagatcttcagttgctcagaggacctggagacttaactgtttcttcaataaatattccactaacccttctattgttagatccccatttgcactcccccactccccaccacgaagtacctgggccaatcaattcctgagcctctgggggttccataatactcggtttttccttggctttctccattgctgattgaggttcctgctttcttgggcctgctaaatcaattagcatatccatctgcttaccagctgctgaaattttgttcttattatctcctctctttttctttgttgtcctggacttctgccttttgttttgcaaatgtctttacagtcatgggagttaagtaagggatttcaggaaaggtaagagtacacatgtgtattctaattcactgtctttaatgggaagtggagtctatcattttcaagttgtagaaatgtagtctataatataattttgtagggaggaggcagcagggagagagagctgtcctatttaaggattcctccaacaggaaggagcagtggctaataattgcattcagcccaccatgtttaagggctagtgctgactcaatggatatgtattgaatgaatggatgaatgaatgttggttattttgcataatagttttgtactagcttaaataatttaaagtcagcctattaaatactcccaagatcacccaatgtgtcatgtttccaccaaattatgcgaacagcatacaaagcacttaaaagtggagtagagacagagaaaacaccaattacttggctcccactttgcctccgtgataggactctttaatacatgaacttctctttcctttagaatgtggcttagagtggtgtggtactaatcccctcatgtgttccataattgggttatgagggtctgtcctcatctttcctgcctgagaaaagcagagaagaactgggtctcaggagaacatgtgaatatagtggatgtgacacatcaattccagttgtgttggcttcagacctttccttgctctccatgccccacccccacctcctgtctattccaaagagggtagggagtttttcactggcccctcccttccacagctccagattctgtcctctcattggtttattttcccttcaggccaggcagtgggtggaaggatgagtctatttactgtggcccagctgctttatctaactcagggaaacaaaaccagcaaatcagagcagtcttctgactagcttatactgactggtacaaatttatcactgatgtgggatacactttactgccaaaacacactcactgcctgaatcttaaatatgattactttgacttcttaacctctcttcttccaaaaaagagaatcaaaataatactttgtaggaaaattgctgatacagactttcttcatcctttgagattagatcatcccaaacagaactttgagtagcctcctattaatctttttatacaacatatctcacatgattgtggcttaagtaatgcaaatattatggaagttgttagtgccaaatattatgaaagttgtttctaatattagaatattagcaatttctaattcccttctttcctggcatgccataggatttcactcctctgacttctctgaaggtaggtatagacagatgatttgcattggttttaaaaaaaagtgaggagatgctttgagtcagtgtgtaacttagcatttacccttgcctgcctgtccaaatggatcttccatcagcctgatttcttgagtgactgtaatgagaacacacccttgcaaacttattttgaacatgtaatatgaataagaatgaaatttttgttgggtgaagcactgagatttggaggctgtttgtttctgtggcataatctagcatttgctgactgatagaaacttgatttttgatggagactgtataattcagaaatgttcataatattttacagtggaataggtatgttgtgtgcatgtgtgtgtaagacatagaagcaaaactttgcttgacgtggggttaggagtctggagtcctagcttggcctctccttccttcctgtagactcctgaaacaccttatcacaatcttattagaagacagtttgaaagccattaccaaagactcccaagctaatatcaagaaatttttacaattaagagtttgattcttccttttttatacagcagcaatgtgaaaaatctgttccacaaccactaaataataagataaaactaattataatcaggcgaaggcaataaaaactaaagcaatgagagtcttttcccagtgaatatatcataatcacatacacatgggttaagtatgaagccagggtatgtgtttgcttttccatgtgaagcagagctttgagaatgggactgaatatcagcataggaaccaggagatgtcgtgttagcttgtcctaccctgggtctgcttttgtcttctcttcctcacctgattcctcatctcaatgtcagccctgctgtcagttcagtgattacattttagtcaaagctacagattccaatgctttcaagcatccttaaatgttatggtgtcctaatcctttgaaaatctgaattaaaccatggactccaggaaaaaaaaacagatctacatgcttaaaatatgcatcaagttgcaaggatttcaagacctgcctgaatcccagcttaagaaaccttgatcaaatggtttttcaaatttacagaatgaatttggcctcttgaagttgtgtagatttctgcatttggtcaagatgtgtatgaaataagaacactatagtaagtagtttcacatactggttaatatttcaagggcatctcaaaaagtagaaatttttaattccatttttttattgtggtaaaatatacatagcataaaatttaccattttgacaattttttagtcgtatagttcagtggctttaagtacattcacgtttttgtgtaatcatcaccaccatccatctccagaacatttttcagctttccaaactgaaactctgtattcatgaagtaataactttccattctcccttccctctagtccctgacaaccaccattctactttctgtgtttatggatttaatgattctcagtaactcatataagtggaattatacaatatttgtccttttgtgactggcttatttcacttagcataatgtcttcaaggttcatctatatgaagcatgtgccagaatttcctttctttttaaggctgaataatattccattgagtatatataccatattttgtttacccattcacttgagctgctcccaccttgtggctattgcgaatattgctgctataaacacaagtgtacaaatatttattcaagtcatgctttcaattcttttgtgtatatacttagaagtggacttctggaatatgtggtaattctatttttggtttttaaggatctaccctactgatttccatagcagctgcatcattttacatttctatcagcagtgcacaagggttccaatttctccacatccttgccaacacttgttattttctgtttttcttcttctttttaaataatagtcatcctaatgggtatgacgcggtatctcattgtggttttgatttgcatttccctaattattaatgatgttgaatcccttttcgtgtgtttattggccatttatatatcttcttttgagaactgtctattcaagtcctttgcccgttgtattaggccattctcacattgctataaagaaatacctgagactgggtaatttataaagaaaagagatttaattggctcgtggttcctcaggctgtacaggaagcatgatgctggcatctgctaggcttctggggaggccttaggaaacttacaataatggcagaaggtgaaggggtagttggcacttcacatggtgggagcaggaggaagagagagaatgaggaggtgccacacacttgtaaaccacagatctcaggagaactctatcatgagaacagcaccaaagagaaggttctaaaccattcatgatggatccacccccatccaatcacctcccaccaggccccacctccaacatttgggattataaattccacatgagatttagataggagcacaaatccaaacaaaatcacccatttttaaactgggttgtgtttgtttttagttgttttacttgtaggagttctgaatatattctggatatcaaccccttatcagatatatgatatgcaaatattttctcccattctatgggttgccttttcactctgttgatagtgccctttgatgggcaaaagttttcaaatttttctgtggtccaaattatgggttttcttcttctgttgcctgtgtttttggtgtcatattcgagaaatcattgccaaacttaatgtcaaggagcttttcccctgtgttttcttctaagagttttatagttttagctcttatgtttacagatattttatctatttttagttaatctttgtatatggtgtaagataaggatccaatttaatctttttggatgcgaatatccagttttcccaaaaccgttcgttgaaaagactcttctttctccattaaatggtcttggcacccttgttggaaatcacttgaccatatatgtaagggtttatatatctgggatctctattctattccattagcctatatgtctgtctttatgtgagtaccaccctgttttgattactgcagttttgcagtaagttttgaaatcaggaagtgtgagacctccaactttgttcttgaaaaagaactttgttcttgaacaaagttgttttgactatccagaattccttgagattccatattaattttacagtgaatttttctatttctacaaaaaatttgttaggatctcaatagtatttgcattgaatatgtggtctttttggggagagcatcttaacaatattgtcttccaatccagaaacatgggatgtttttctgcgtatctgtggcctctctaatttctttctgcaatgttttatagttttttttttttgtttttgttttttttgttttttttttaacagagtcttgctctgtcgcccaggctggagtgcagtggcgcaatctcggctcactgcaagctccgcctcctgggttcatgccattctcctgcctcagcctcccgagtagctgggactacaggtgcccgccaccacgcctggctaattttttgtttgtattttttagtagagacggggtttcaccatgttagccaggatggtctcaatctcctgaccttgtgatccgcccacctcggcctcccaaagtgctgggattacaggcgtgagccaccgcgcctggcccaatgttttgtagtttttagtggagaagttttttacttccttagttcagtttattcctaagtattttgttatttttatgctaatgtaaatagaattgctttcttcatttgcattttggattgttcattgttagtgtatagaaacacaactggttttttgtgtgctgattttgtgtgtgtggaatctttagggttttctatatacaagatcatgtcatttgtgaacggagataattttacttcttgctttccaaattggatgcctgttattcctttttcttgcctaattgctctgactaggactttcagtcgtgtgttaaatagaaggggcaaaagctagcatccttaccttctttctcatcctaaaggaaaagttttcagtctttcaccattgagtgtgatattagctgtgggtttttaatatatggcctttattatgttaaagtagtttccttctccttctagtttgttgaacattcttatgataaaagtgtgttgaattttatcacattatttttctgcatcaattaagataatcatgtagttttttttcattattttaatatgatgtgttacattgattcagttatcttcttaaaacagggttaaaatattctcaaataaaatccaggctaaaggaagctttaatgtgttgtctcattgttctatgtgaacctagacaaggcctctcctctcttctttctaagaagtcctctgggtttcttacacttctaccttttgcttctcactttcctcgtgggctcctcatgaaaatatattttcaaatacaaaaatatttgcctcttggaaaatatgtaaatccgtaaccctagaatcatagatggctaagactgaaaatggcttcagagttcatttggttcacttgtcacaaaaacagaaaacttgctttgttttaaaaaaaatgtgctattgaagtatatttcaacagtccaggtttcatttctcattacataatttaatgtaatgaggtttgatacatacatataaacagggagaaaagtgattacatataggactggctatgagtagatcaaaaactatttcacttcaactggaatatgtcttcttcccaatgttgctcttaggaaatccatctgactagttttatacatcagtatgctaaatgaaaaaatgcactttaccaaaaatatttcacttacatcatctcactgagtccttcaaacaacccagtgaagtagatattataattcccaacagacacatacaggtcaaaagagtaattataggccaggcatggtggctcatgcctgcagtcccaatgttttgggaggttggagagggaggctatctcttgaggccaggagtttgagaccagcctgggcaacatagctagatcttgtctctacaaaaaataaagaaaattagccaggagtggtggcatatgcttgtagtcctagctacttgagaggctgaggtgggaggatcatgcttataggaccaggagttcaaggcttcagtgagctgtgatcaggccactgcactccaacctgggtgacagagcaagactctgtttctgtaaaaaaaaaaaaaaaaaaaaaaaaagtgattacaaaatgatagtcaaaaagacgtgtggagaattctagagagaaggaatacatgattgcagtttgagaaaggagttaaaagtttaagttgttagatgcaagcaaaagttgtaaaaggatttattagtattaatattaaaatggtaataaccatataaagtcatggtcttaaatagaaaattatttccatttatgcagccaacagacacgtgaaaaaatgctcatcatcactggccatcagagaaatgcaaatcaaaaccactatgagataccatctgacacctgttagaatggcaatcattcaaaagtcaggaaacaacaggtgctggagaggatgtggagaaataggaacacttttatactgttggtgggagtgtaaactagttcaaccattgtggaagacagtatggcgattcctcaaggatctagaactagaaataccatttgaaccagccatcctattactgggtatatacccaaaggatcataaatcatgctactgtaaagacacacacacatgtatgtttattgcagcactattcacaatagcaaagacttggaatcaacccaaatgtccatcagtgatagactggattaagaaaatgtggcacatatacaccatggaatactatgcagccataaaaaaggatgagttcatgtcctttgtagaaacatggatggagctggaaaccatcattctgagcaaactatcacaaggacagaaaaccaaacaccgcatgttctcactcataggtgggaattgaacaatgagaacacttggacacagggtggggaacatcacacactggggcctgtcctggggtcggggaaggggggaggaggtgagggatagcgttaggagaaatacttaatgtaaatgacgagttaatgggtacagcacagcaacatggcacatgtatacatacgtaacaaacctgcacgttgaaaaaaaaaaaaaaaagaaaaaaaaatatttccagttctgttactaaagtgacctggacgccaactgctagtacacaggtagaaatctttaatatgtgctcccaaagcccagatttaggcttctaacctattgtccattaaaagagctttgctttttttttctttttttttctcttttttaagacagggtctcactctgttgcctaggctggagtgcagttgcacagtcatggctcactgcagtctccatttccagggctcaagtgatcctcctgccttagcttcctgagtagctgggactacaagcacgtgccactatgcctggctaagttttgtagaggtgggatctcaccatgctgcccagaatggtctcgaaatcctgggctcaagcgatctgtctgccttggccttccaaagtgccgggattacaggagtgagccaccctgcctggccttttttatttttattttttattttttgaaaagagctttttttgggtgaatattggattttatatctgaatgctggatgaaagagatagcttgcaaatgagctgctgatatgctatgagttgccccatttctcatcaagaaaattgaaataaactgcgattttatttatggtggcagaaccaggacgatgttgccagaatgaagaaggaatgggctatgtggagattgtctggagggaaaaataaggtgggtatgaaacatttgtttttactagaaagttaagtctgagtccttgatgaatactaaaaaagagaacaattaatataaagcagggataaggaaatcataatgaaaaaataaggatgatcagaataggaaatgtttcattctatctttattatatgaggcagtattcattttaaaatgcgttgtatacttctattaagcatgtgcttatttatataatatcatttatatctttttcccctatctcttgtagagaaggctagctataggtaactgtaaataagccaactatttccagaaaaagttagagctagaccaagattgattcgctctgatggccacattcaataatcacatagagaatctaaaaaccaaaaactaaaaaacacaaaatatacaaacatttaggatttaatgctgacctcatgcctataggatcaggcttaataataagagatggtctttgaagtattggaaacaataggaaataatgtattttgcatttaaagggcaactattattattgcttaccagtgattaagagacctagatgaccaatcccatttgctctacaagaatcgattattgggatcagctattatagttggtacaaagaagctctaggacaggaataggttcatccagcattcaggacaagatggagaaatggaaatctctgaaaacaaagctaatgaaaataaaaaatggaaaagactggtaaaaccaaagagatagcttgcaaataagctgccgatacgctatgtatgagttgccccaaatctcatcgaggaaattaaaataaactgcgattttatttatggtggcagaaccaggacgatgttgccagaataaggaagggatgggctatgtggagattgtctattaaaattgtaaggattttgccttcatgtcgtcggtacttttgggatgacatgatgttcttaccacccgtcagacatgcttcttcaggaaaggtcaagacctggacctcagagaaggcactccaagaaggtgtgtacacctggagactctgtcgcagctgcaagccgttctctctctgaataaacagagagtcccacctttctttgaggagtatccacactgtcctctcccccaaagcaacagggatttactctagcagggaacctcattggaagcagaagaatcagaatttcctggggacaaatgtaccatgtcaaagtcccccaaatgattctgacccccatcctacttgggagatgctaactttccaggttgtgaatcacacttctcaccaacttaattgcaagggctttaactttcacaacagtaaaagtaatactccatgaaacagcacaaagtatctggtttccaaaagaaactttttatatgaacccaaagttaaagaatttaaaacaggggcatgatgatttaaatgattaaagtgggctaatgaaatcatcttacaggctacatgcgaaagttcctagttttttggtgtagatcaaagaattccacgaaattcagttaaactactgaaggacattactattgccaataaaaatataatagttaacttgaagagaaagatttcgcattttattaatctgagttttaagaaaaatgtgtgagatgccagtaactcaaagcagcaaacttttattttttctgtaatgtgcctaggccagccatgaagaatacatttcatgtcttgtgtcaattacagttgactcccacggctgtgctgggcaggatgctcagacccactctcactcagggaaagggggctttaatcaaactgattagtctgcccttggcaccaacacgcattcccacaccatgctaggaattcctttctgtgaagcgattagaaattacactccttatgcttgaatagcttttagtctggtttgggaattaagacccaaagaggtgagaaaatagagcatttctcaggcaatatagacacttccatcaatctcttctgtgctcctcttgtgggactaattgctcctttcttgttactgccatgagcattttatgagcactgttacagggctactgcctttgttattgttcttacatggttaccgctcccctgttagtttgcaacacccttgagggcagtgactgtactccattgctccagctcaattaccgtcagccctcagcaccctggtctgtgccttatgagttgaggggccctctctgacaaggagatgagcatatgaagggggttaaaggaaatcagataagtggggtggaaataccaggctttgctctcagctaactaggccccccttgttcccacccctaagtccccagttttctgggcttatgtctacagccttcccattgagtctatcagcaagcaacacttggcaactttcaaataaattcctcttctctttaagttccctgacttgagtttgagttgcctgggacattcttccacaaagacttagctttttcctccgttcatacctctgctcccattacccacttcccttatgacatggcatgataggaggtgcagaatggaaagagctgatggagattcccagagtgcaggatttccagtcggttggctctggcatcgaattccagctctgccacctactgtatgactttgggcaagtgatttgtccctgtgagcacccagttagccaggatgaagtggatgcaatgtctgcctctggaaatagctacgagggtcaaggcagatgatatatcctaggcatacagctctggggacacttattatccagcttccctattcctcatttagcagtcattgccatgtgcatcttgtatattgtgaccatttaaatcttttattatttatcttcttatatactgatgccttatttgcctccctgcagggaaaaagcttgaggccccatcctcactccaccccagcctttgcaaagttctatccatagtaggtgctcagtgtgtacatacatatgtatgtatatgtttatatatattgattgattgtcagctcgtggtgtatattcacagccatagagtgggctcattttgctttattcattgacatcatgctgcctgctgcccatggtcttgttgactggtcaggtttgctgtcccactccgggagggcttctaggtataccactggacagattaggactgatttcagggtttttcctggtacatatccttgcggactgattctggacagtgtcaatgtcctccagccaaagacctctaaaaacatatctgtagttgaacaagttgaatttcttacttgtagcgagggagtatacacaccttggggaacagtggaaaatttaaggaaaagggtgctagaaaagacttactgtgcagaaaagagctaacatagcaagcctgagactgctaccctttcaaaggcctgcttgctaggttggcccttggcccatgtctgggaagctggatttggggaatgttcccaccattccctaactcataagagcagcccactgtgcctaaagtgtctgtacagacaatatggtctatgctaacacctgttttccttctggaagtctggtattttggtttgtgctaggcagaaagcgtctgtggagtcatcccccaataaaacacaggcactgagtctctaatgaccttccctgataacagcatttcacactattgtcacaacttgatgctgcaggaattaagcacatcttatgcgactctgctgggagcttgggcctggtttccttcgaaaatcaccccgtgtaccttttccctttgctgattttgctgtgtattctttcacagtaataagtcttagctgtgagtctgccaatatgctgaatcttctgataccactggcacatttataagatgtgagcttaccttaggtgactttggggaggatgtaagggtgtgagactttgctctggatcacatcatctcaaggagcagtggtaattctataattgggtatctcagtaaatcttatccaggaggagggaagattacaacaaggactagaacaaggccaaagctgtaattggtaaagaagcagcagtcacttacattagctggggtagggaaatattgtgtattttgtggctcgaagaatgctcttgttttgtttatgttcagacatgattacggaggagtcgtgcttcgtcatggtcacagagtggccttgtttgaggttgatgcttggtgaaaatattcacattcaacagaacacccaggcccaactgtgagggcccatcagctccgcaatgtcagcagttgcttttctctctctcaccagtaatgcattctcaaattgtctcatctttgatgtcacagctttcacttaaaccgaaaagtttctccataatggtttcagtttctcaagcctttataattatagcagacttccaatttcctgtatccattgagcgaaaatccctcctggtggagaccaagttattggaggaggcctaacccataggacagagatcaaatgattttattctttttttttttttttttttttttttttgagacggagttttgttcttgttgcccaggctggagtgcaatggcgcgatctcggctcactgcaacctccacctcccaggttcaagcgattctcctgcctcagccttcccaagtagttgggattataggcatgcgccaccaagcctggctagttttgtatttttagtagagatagggtttctccgtgtgggtcaggctggtctcgaattcccgacatcaggtgatccgcccacctcggcctcccaaagtgctgggattataggtgtgagccactgtgcccagccttattctttgtaataactgctaaccagtgtactgctttccccccggacagtgggctctccaaatatttaattcaacctattttcatgacttttgtcactggcatttattttagcagtctcttgttggctgagaagatatagttgtatgcactgaggcagcactgtccaagtctgttcacagctctccttccctgcagcccaaggttgaggttgtggccctcacgaccacctcaggcagctaattgcaatcttttgactgcagcctgcagctctaacagcatcagtcactcagataagcatgcctctttgccctttgccctgggtaagcctgcaactctaatgccaattaattcccagcaacatcagttcaggtgctgataggcacaggtgggatccatttttcaagcctatcaggagctgttccctctctctctgtccatctgaatatttcacccctcaccagggctcccctttctactcctggaacctgggcggggagggctgaaggtctagtagctaagaaattattccacctaggaatagaatgttcagctcccatcttgcaggcagttgtgagagatttttgcagggagcacttctccttggctttgagaagaaatctggtctagaggcctgaccccttgctggagagagaagagtagcttgtctttaaacctacatccctgagaatgatctctttgacatcttctggaattaggggatgttagctcattctgttaggggaacactcagtgtgttccccgagttggtggccctctgagcttagcctaggagaacctcatgcctttccaggcagtgggtcctaacttccagttccggagaaggatcccactcagcacttcacaacactaattctaatttcatcaatcagcaatagcggaggacaacatcatcttattagggaaccgttgagaattatggcgaagcttctaaacttgcactgtccgaaatagtagccactggcccttgtggctgttgagccttttgaaacatgaccagtctacattgaaatgtgctgtcattgtaaaatacatatcgcattccaaagacttagtctaaataaagaacataaaaatctcaataatttctttatcaattctttgttcaaatgataacatttttgatatattgggttaaataacatatattatcaaaatgaattctgcttgtttctttttaatattttttaaggctgctactagaaagtttaatgttaactatatgactcacattatatttctattggacagggctattctagaccaggagttgaagaactatggccaacttaggcccatccatcttgaggactgtttgtgtaaataaagttttattggaacacagccacaccatttgattacatattgtttgtgatggcttttgtgctacaatggccaagctgagtatttgagacagagaagcctggggaacccaaaatatttattatctggtcctttgcaaacaaggtttgttggtctctcttctagactatcaaataaaatgtatttttttttttttgagacacagtcttgctctgttgcccaggctggagtgcagtgatgggatctcggctgactgcaacctccatctcccgggttcaggagattctcctgcctcagcctcctgagtagctgggactacaggtgcatgccaccaggcccagctaacttttgaatttttagtagagacaggatttcaccatgttggccagatcgctctcaaactcctaacctcaggtgatccacctgcctcagcctcccaaagtgctgggattacaggtgtgagccactgtgtccggcctaaaatgtgtactttaaacttatgaaacttattgaatacttattgttcaatattaaatatatattatagcattttaattaatagaaaatgaatgcatttaggctaatcctatattaagctgggtgattaaattatcataacaccttgttactcaaattagtgggtagcagagaatttccttatgagttttatcatgccagtatccttctgagagtttgtgctcacttcctcattgattgtccctgccacacagtgcagttaatgcccacccatgaattaaggaccaaacctgggaaaattggattactactttcatatatgtgtcagtgactagcagggctctacatcaagataaatttccactgcgggtgagcagtagccatgatgattaaatggaaatgcttgtctcagcctcaaatcacaggctgaagatatacactgaaattacagttacacagaaaacagtgttctttcagaatggagaatggaaccttctgcatgagaatcgtatctaacaacatgtggtctcctttcttgaactcgtgtggcggagccagttggcgcaaatgattatactcttcatttccctactgacctttcatcttttttattcttgtcaattttcattgtgaagcattaccgtgttggtgggggtgtgtatgtcacgaaagcacgttctgcaccacactaaaaattatggccacaaaacctctttaaattacaccctaatagtatttccttggaagtcgttatgaattttggttcttcctaacctttgccactggggatcaaatagcacagctcaacgtttccgttgctgcattttataacagtggtaatgtaagaatttactggggactttatatacacagacaaaagcgtgccactttacgaagctattaaacaccatggattttcccacatgagagatcaagcttattgtatttctcaagtatcccagcagtttcccccacagcccagctccattgtgtgagatggtgtggttggctcagccattctctataccaaggttgttagcatcttgactgcaacccagcgttatcatgaaggcatagccacagagacaacactccgttctatcaccacgccttgttactgcaggacacctggcctctaagcaggaaaggttattatattcccttttgacagtggaagcttttcaaggggccaacaatgcatttttttatagcagagattaaagttaaaaacatgacaagcagagagcagtctgcttttgtgtgcagacatccagacatttttcgccaaagaaggcaataagccgcgcgataaaaattctagcttgaaactcccagggttctccaattagatgcttatcttttcttttatggctgaggctttaagacaaaatttctaatggggaaaatatggtttcactactgaaatgcatttgctatggaaatggcaggctgctgaaacatacaaggcaaatgattaacatgaaaaataaataagatacctttatgtttataagatcttaaaattgagaatgatactctttccatttaggacgagcagtggtactcattaaggctctctttggggctaatttagttattaaaatcaattgtattttatggcaatgaccaaaacatttcttagatttgagggtttgtgttttaaaaaaattaagagttcactgaatctggaggtatttattgtgtggttttagtcactgatataactccaaaaatatgtgaagctgcctatgagatataaatcatccgactgccaaatgtcctcatttcttctgcaattggaagaagaggtaagtttatttctaatggcgggctagtgggtatagtagtcactgtggtgacatcaggacatccatgtggaaactgcagcgtgcagtagcagctaaataaatataaaaagtggtatatcggttgtgtacgattaaatcacaattgcgcagagaatcctgatctgttgggtggacagttcaccaaaggcatgaagattttgcttcgaattcaccaaggtttacgaagcacaagagtccacccagcgacctctgacgcatcgtgtgcttttcatttattttcatgattccccagagacctgggcccattccattgtgagcccttaggaaaagtaatcacatactgggaatattcaacagttttgattttgtagccctcatccacttaaattttccttgggactctgagttcacagtcaagtccagtgggaatgcctttaagccagggaaagtgaatgcagccctgctggtgctcagatctggaaggagtcataggacctgctgggtagaaatggcttctactgacttatatttgctgacaggatgctgtcaggggaatcaaggtgctgtcggaaggacagacttggtgaaggggaaatacaagacattttaaggtccatctcctgaaaaaataaacttaaaaaagagtgaaatgatggaggacttgacccaatcctccggcactattcaggctgcacatattttcagcatctgtcataaaggctcacagtgctatgaggaactcgaagtttaatggtgtgtaaaatttttttttaactctcttgttgcctcttagctgctccttgcaaatgtggaaaaccatttttttctttttcttttttgcatttagttttagaagcacaaagaggaaaatacaaagcactaaccgccttgagtgaaatgcgctgagaattttatactcaggaaaacatccaaatgccaactctacttggcttgtggaaatttccggactccaggttcccagggccctgatgttaattttcttttggctgctcagactaccctaccttatctacctatcgttgtttaggatcccaaatcactgattttctccttttcaaagctctccaaagtatctggtcactgtttggtggaggaaatcaatgttgaattcagtcctcagtcactcactcagccatgcttgggaatgtggggaattctattcaaggagaaatgagtagaaaataatttttaatttcaaaaagaatcccaggtatctctacactgtggatatatgaatactgtacaatttacgaggtgctggcaaatatactacattacacagtacaatttcatgcaatccatggagctccaaatgccctttagagtgtttgaagccaacattacaaatacaattttaaatagaggataactaaatgggtgttgttattctgttcagagcctgctaacgaattctcaagaacgtagcatgaattggttgtcaaggtaatgtctgggaaggtggcagaaactgtcactaagccaagtggaaaaattaaaccctctctccgtcatattccaggaatcctcaagcaaaaagaaattcctagacacctctcagagccttttgtgtcctcctttctttcatccctcaatcctcttttccatttccccacagatgaccaaacaaaatagaacgttccccaagaaaactgatttaaagaagttgagttcagggtcagtcttattttattttatttttttccatctatggatctttcttttagtttgtaccctctgggctgattcaaattagaagagtattttcgactctacagaggacacatggtggaataacctaaattggaaatgcatgtttcatgataacagacatttccactcttgctgggcatttccaattgctgtaaagcacctctgtgacatgaactaatccacagaacctctggagactcagcagagaaactgaggccatgaaagtgattacagggccattaagcataaatggtggaaaagaaattacatttgaattttttcatgttctgctctcatataaattacataagacaatggaaagaaaagaccatctgggtttagatttcataaaacgagactcacatctgctttggtatgtcatataaatattccttcattagagagttcaatctatgaaacacttttggtcaaaaaagcattttaagaaaaaagagggggagattgcttttcatggatgctgattattttcaaatcctcagtcctaaatatcaaccagcaaacacctcagaggatttttttttaacatttcataaaacaagagtattttaatagagcaagaataaaaaatagtgggacattttatctttaagcaaagaaaattcttccttagaaaagatagttgccaatctaattcaacatttatatctttctttcaagctttcttttttttattattatactttaagttttagggtacatgtgcacaatgtgcaggtttgttacatatgtatacatgtgccatgttggtgtgctgtacccatcaacccgtcatctaacattaggtatatctcccaatgctatccctccccccaccccacaacaggccccggtgtgtgatgttccccttcctgtgtccatgtgttctcactgttcaattcccacctaggagtgagaacatgcagtgtttggttttttgtccttgcaatagtttgctgagaatgatggtttccagtttcatccatgtccctacaaaggacatgaactcatcatttcttatggctgcatagtattccatggtgtatatgtgccacattttcttaatccagtctatcgttggacatttgggttggttccaagtctttgctattgtgaatagtgccgcaataaacatacgtgtgcatgtgtctttatagcagcatgatttctaatcctttgggtatatacccagtaatgggatggctgggtcaaatggtatttctagttctagatccctgaggaatcgccacactgacttccacaatggttgaactagtttacagtcccaccaacagtgtaaaaatgttcctatttctccacatcctctccagcacctgttgtttcctgacttttgaatgatcgccattgtaactggtgtgagatggtatctcattgtggctttgatttgcatttctctgatggccagtgatgatgagcattttttcatgtgtgttttggctgcataaatgtcttcttttgagaagtgtctgttcatatcctttgcccactttttgatggggttgtttgtttttttcttgtaaatttgtttgagttcattgtagattctggatattagccctttgtcagattttatacagaggattttatgtagttttattttcagaaattaaaatatcttaggctgtgtctactttggccaagtaatgtacattgcttttttatttgttaaatgggagatttggtactttttttaaaatcaaaaataagacattttgtgttcagctcagcttttaaaaagggctggggatggaaaggtgcacatttggtctcatcatacttgatgaatgtttccagctccattgaattatttagctctccagcaacctcttttgcctcctccttttatcacatgctatctcttggctccatctactttgtgtcggtttcacctcaaaattcacgtgatagcaagatggtggcagcaggttcagactatgcaccctcttaggttcaagcccacagggaagagtaagaagtgccttttcagaatcttattgatgctgaatgggtaatgtgcctatcctggatctaatcaccaatcacaaagcctggggaatgtggtattctgactggctgaggcctaaacacatgcaccactcctgaatcgggggagtcagtcccacccacagcttacaggccaagcgttaaggaggattggtccctctagcagatagtttctaagatggcccctaaaattccatgcctcctggtatttatgcttttatgtaatcccctctcctcgagtgtgtgctgggcctagtgactcatttctaaccaatggaatacggcagagatgatgggattaggtcacatgagatagtgacttccatcttgctagcagactctctctattgccttcttggttggcacattttgatgaagcaagctgccatactgcagagacccacatggccaggaactgagggtggtcttcagccaatagccattgaggaaaggagatccctattataaccgctctcaaaaaactgaatcctgggaatagtcatctaggtgagcttggaagcagatccttcgtcagccaagacttcagatgagaccccagccaaggctggtcacttgattacagacttatgacagaacatgaagcaatgaatctggccaagccatgcccagactcctgactcaaagaaactgtgcattaataaatgtatattgttttatgttgggatgtttgtggtagtttgtcatgcagcaatagataactaatacagtgcctcatgaaaatttgggggtacagtgtagttgaagtgtgggcaacagaaacaacagctgcccacaatagcacattgtaggcatgagttaatgaatccttccaacaaccctacgaggtgaggaacaattgctttcccctcattttttgaagatgagaagactaaagcacagagaaattaaacaaccagctcaaaattacacagtgagtcaaaatagcactatgaaaatgagaatggagagggtagaatgggctattggtagagcaaattttaaccttaagtggtgtgaactatgattgcttcctagtctctgcatagttaaaattatactcagagaatttatttccaattttggagattttaagtgccacactaaacaggaaccttctccatgcaaactgctaatccttccaagcagccacacaaggagtcttaagaatcaactaaacttattggccccaaactgtcaggaataacaagtcattgtcacctgctgtcagccctgcctctcttccccagcctactcatgaggctgccacaatatgttctttccagagatgtttctggaccagccctaatcaggatcgagactgtctcatcaatctcaagtccactagtgaagggctctggaaccagttttgctttccttgccccaggtcttgcatgccaggtatgggccattaacatgatacaatgcctctgtcacagctgtccctgcccgctcttctcctgcgacgttaacactgcctgcttgcctgccactgctggttttcctgccacgaactgcattttcctgaccaggcagggtccctggaagacaatacatttgcaaagaattgaaagctctccccttcagggatgtaataaagcaatccaagcacagggaaaacgttgggccaggtggattttaagggctcttcccatcttgagaagctgtacttgtctgtttgcttgtcttgctctgtcttgtattacagtagctttcattcttattttatttcttcttttagattgtgatctttttgaggtccatgacttcacgtatctggcgcataaatatttttaattttaaaaaatatatcatgcttactgctttgatatttcttattgtggagatggaaatgaatttagggaaaaaagacattctgaagagaagtaagttatctcagaaataaaaatagctttttatttttagaaaaaatgtttccttttcatgttgttcttttatatttatcctttatgattcactcaataagcacagaattgtaatgacctgtgctgtaactaatgatgatggatgtttttgtttcaggtaaaaacaaaccatctcacaaaaaaggcaaaggtgtccattaatactgctgattatttatagcacattttggaggtcctaccaaagattagagacatattacttagttttatttttaacataatgactgaaatttttcacactgcttagcagaatggaatgaccccagatattatttctaatatagggcaggggttgacaaactacagcccctaggccaaacttgggccactgcttatatctgtaaataaagttttattgaaacaccgccatgtccatttgtttacatattgtctattgttgcttttgcactacaatagcagcattgagtaattgtgacagagaccatatagtcagaaaagccaaaaatatttttttggccctctacagaaagcatttgctgacctctgacagagtgtaaacaccgctccttaacttgaagggcagttaataatgtctaagctttgatttgatttgatttggttctatggtgctgatttccttttgagcaataagcaattggtagttttttagtgcattttaatgataccttcctgtaaagaattttcagtctgtttgcctatggatatgcatatctggtacaaggctcataagctctttttccaaactcagagaggttaattggccttcgtaaagttgcacatacaaatggtagagagcccagaggagacctcaggttcacaattgcaaagtcatgctacttgtgatgatgatttgtgtttgcagttgtgatttctaccttgtgcaaaaaccactgtaaaaggaatatatttagtcaaccacctggttgtctgttaaccagttaacctgaataataccaataccaacatccacgttaatgccaagccatcacatttccagacaaatgcgtctttcaaaatgcaatacaagtctcatctagtccatgaggcctttcctaagtgcctaagtgagaatgacacttctgctttgtacctccagtgtgtctctctcctagacccaggagacaggctcctgggcttcaagctccaagggtcctcctctgtccacacctctccccaggcccaggattctgttcggctaagtagatgaggagcccccttctagaacataccccttgtaacctagacctaagaattcactgcccaaatgtcctaagcccacttctgagcctacttggattcttcctgatgtcccttgtctattcaagggtgggggacaggctgtgctgctgtgcatactcccaggcctgagagttgcccaagggggtggcagtttgcagaatatttagagttcagatggcatttggctatgcaagacaaggtgtccattcttatgtgtctgaggccccttgtagtttgtgatggagctggggacaggaagagaaggggctatgctctgaacaggcatctatttaaactcttgcctaggccctgcaaacttatcatgtcacttaaccattcttgctctatctgatttacaagcagtcttctggctaaactgaactcctggaatgcaatgtttcacatgtatggtacctgcacagtggctgggacattgttgggtgctcagtagatactcaagcactgaaaggacaataccactgtgtccataccaaagggaaagtcagtgttccttgttactaatactgcctaacaaaccaccccaaatttagtgctgtaaagcaacccttttttatgttctcaattctttgggccaagaatttggaaagagcacagtgggatggcttatccatgctccacaatgtctagggctcagctgggaagattcaaaggctggggggttttgggcgggatggtggtgactccacagctgaggctagaatcatctggaggctcactcactcatacatctggcaggtgattctggctgggaccagaatactacatgtagcctctctctgtggctgcttgggcttcctcacagcatggtgtctgggttccaagagttactatccttaaaataaccaggcttggaaatcactgcagtcacaagcccactgaagttcaagatgaaggaatgcagactcccaccttttgatgggagaagagcctaagacacattttaagaagtgcatgtggggtaggaaatatagttgtggtcatctttacaaaaatagaacctgccacagttaggtagatattcttttagaaaaatcaacacactaccttgacctgtggggagggagagaaagctttttcaaataaagcaaaacaggaaaaaaaaatctacttttactgcgtttttgatcagagatattatgaggaaccgattgtaaaaagcatggattgcctctatgaggtgagaggtctaaaatgtgctccatttaaaataatgattaggggcttgcaatggtttctttctcactgagtggttgatcgtttcattgcattcaccacgtcccagtggtttagagttacttctatatgaagtactaaaatagcttttcaaaaataagacagaaagtttcatgctctaatgaactaatatagtaaaatgtcgatattattaactggaaaaagtagtagaaaaatgtttgagttaaactcagctgtgaaagttcttttctttgggaaagtacttgtattgaatagtgcttaatttgactttatcaagaaatacagtcatcaccactaacacagagaaaatgtgtgacaaacaaggaaacaccgtatgtaaggattccataaatttgttcaaatggtttaagttttgggtacctaaacaaaatacaatgttataggaaatcttaagaaatttgaaaatgtatatgttttgaaaatagcaaagtgaattcaaagagaaggaacaatatgaattggtggaggccactcagagacatggttgcaaaaatccaaacagggtagcttcccacagtttcttaaaatgttttatctaatatgcttttttaggttctgaaagtgtctctcttaagaaactggagatgtgtgcttccaaggcaggatcagaagcggttttgagtggtatcttccgggatctcccacaaagcatttctttgtatgcgtcatccttcttccaactccacccacttagaagttaagcaacgatggagtccttgcttctatctccttttgggtctcagagtggggctgactcttaactccaaagcatctaatctcttccaagatacctttctatgaatggaacttttaggtcttttctgacaaccactagcctgccagggtcctcagggtgaataagcagactaagtttaccttggaggttaagcacacaacaaaatcaatgaagagtaccttccagttgtgttagcccagaggttttcaaatccactccacagaacatctttaatgcccacttgtggagaggaaaggggccatggcagatggagttctgtgtacctagccaaattttaatcagaatgcctctgggtttatctgttcatggattaggcttcctcactagctttaatttgaagaacttttgaaagttagcaaagcactccacattttatggttcatttccactttcacctcagttgatcctcataatgctagtgttacagaagggcttctaaacatcctcaaataatttagagaaagctcattcaagttcctcatctcccacccatggtttagcctagttaagaattttttaacaccaagaaccataataatgatgatgataataataataataataataataaccaaaagaggttaattgctgctgggataatgttgccagatgctccagatctcctgcctttggtcccaaagtagaagattctcaggatttgaacattctttttactaagttatttaaaattatttcattgtttaattatgaaaaatatatagatgaatatatctcaagttagtgacacattttgactgtgacttggttctgattagagtctcactattttgcttgttttatgagtcagttgggtaaagagacaggcaggaaggtcacattgaatctcaacatgtcaactaatgaagaacttatttatctgatcaagaaatctgtgcaatgtggcagtcccatcctttgactgggactctgttcttttatgctattctccctaatgctttttcaagctagctctttgctaattcctctatgtcaaggcaatcagtttattgcacgggagaaaagagaatttatatgtcattattgcaactactttgtcttacttagtgtggctggcgggctgtctctaatatggcccccaatgaccctcacttcctgatattcatgctattgtgtaatcctttcttcttcagtgtgggctgcaatagtcacttgcttctaatcaatataatgtgacaaagatgatgggaagtcacttccatgattaagtttcaacatgttgtagtcttcaatttgctagccagataggggtaggtgataaatgtttgtgtatatctcagtcggttcaggctgctataacagaatatcatagattgggtggcttacacaacaagaatttatttctttcagttctggaggctgggaagtccaagataagttaccagcatggttgggttctggtgagggccctcttcctgatctgcctcccttcttgctgtttcctcatgtagtaaagagcaggagagaggaagcaagctctctcctgcctcttcctataagtgcactaatctcataatgaggactccaccctcatgacctaattacctcccaaaggccccgtctccaaatagcgtcacactggggattcagttttcaacatataagttttgggaaacacaaatattcagtccatagcagtgtggcctgccagatcatcctagaatacatctaatctggggttcaggtttgctttagtttgggcagcataactgttataacaaaaggtcccacgatgtatattgggtctaatgcaatggaagtttatttcttgatcatgaaacagtattgggtaaaagaaaaggttggcaatcctccctgcctcatacattcaggggcccagaatgacagaaaatctgccatcttaaacgcagaacttctgaggttgctctgggaagaggggagggggtcatctttattccagccagctggaaggggaagagaacatagagttccatatagaagatttataggccaggcctggaggcggggtacagtccttctgctcacattccattggccctatctcagtcaactgaccacatctaaccattaagggatgcttggaaaagtaccctttggcttagcggccacttcctagtgacaactctatactaaggaggcaggcataagaatttttggttcacagctacactttctgccacactacttctgggaaactgaacaatttgcagtggggtagccaggctagcatttaaatgtgacatgaaaagttctaagcccatcagcaaggtctattatttcccaaccttgtcaccaatacctctgttcttgcttcttccactcaagaaccatccaaccagatcttggccaccacccatgaatcagtgttgaaaccaattcaggccatccatcttcccaggaaaatggggaaacgagatgtcccacttgactgcacattgaagggatgtcttttctccactgtccctcagggccttctgccattgggactgtaacacccagcaatctgcatcagactcgtgctggcatatctcttatagacccacccttgatttttccctcatcagagtcacttccttgttctcaaaccatttcttcctctggtttccttggataccacattttcctcattcctcaatcctttctctttaggtgatgagtgatacatttctccttacatatttatgacttccagttttttatcattaaccttaatttttcttttgagctaaaaactataaacttgacactttcaggtccttgccaatgggcagcccaaatttgacatggcctcctcaatgatgccattcctgactacccatttacattagccaatttctctcaccttttgtcaaatatccacttttatatttatcactgtctgatgttacctgtccacttatttgtttggttatttatcatctatactaagtatatgtacttcacagtgctaagacttcgtctaccttgtgcggagcctagcacagtgcctaaacaataggatgtgcccccatagatatttatcaaatgaatacatgaaaacttcattgtagggagctctccttgaggtcacaggtacgggttgagggacacgaaggtgtaagtagcagacatgtgagttaggtggagctggaaattacttttccaccaagaccattcacaacaagggaaagttcattgcccataaggttactagagttctatcttatcaggggacagtgttgaggcaggcaaaacccaacagatgttcagtaaagtttgtaattattgcataggaaaaaaaatatagtattgagtctctctatccctagatcagtgtgggcaaaattttttctgtaaaaggccaggcagtgaatattttagaacttgtgggccacatggtctctgttgtgactactgaactctgcctttgtagcaggagagtagccatggataatatgtaagcaaatgggtgtggctgtgttctgataaagcttcctttatagaaaatgaaatttgaatttcatataattttcacatgtcaccatgtattaatcattaagattttttccaaccatttaaaaatgtaaaagtcattctgagctatttacattagaaaaacaggcaatgggtgggatctggcccaagggccatagtttactgacccctaacctagagtgtcagaaaactcagccttgtatatgttgggggtttttcctagctcccatggccactttataaatgatgtttcttaaaacattttcatgcagtccttgagcttgagtctccagcggtgttttgggttggaggaggcagtaggaagagagtctcccagccctaaatggttaacgtttatattgcaacataaattatcatttgctccagattgcctgtggtatccatgtagaatgattaatgtcaaaatgataaaatgatgcagtctcttgaatttgattccagctgttcccgtctttgatatgatttgcgaatgacatttgtatttttcactggtgattagttaatgctggaaaggacggccagatgatagctgtctagaattctaaagccaaagatttacttggctggaaaactgttcaatagaatatcgttacaatatttaccgtaaattggtttagcatttgtcattagaaggtgcttagcatccagataacagcctatagtttgaagaattttttaaaccatttgattacactatgattacagaaggctggcaaccaaaaaagacttctttctacgtgattcattgctcctgtgtagaacaccaatgaactcttaaagaactgattcaatgttttctgagagccctttattgacttgttcgtggctagaggaaaacatagctgtgcatcacatagtttggatgttaagtgtcaaaagttcctgggtttagctgctgatgatagcagtgaccatttactgagctacttacgatgtgccagctgctaaactattttacgctcatttcgtcttcacaccagtgcttttaaacattatattacattgtcagaatattcgtccacccaccaagtcgttctaagggcaggtagtcagtctgaggtctattgttctctctgcattttcttggcctcttagactgtggttctctgtgaataaggatggggggtcactttaattcagagtttcttaacttcagcactcttgacatctaggatcaggttattctgtatggtggggccgtcctgtgcactgtaggatgtttagcagcatccctgccctctacccactagatgcctgtagcgccctcacgcgcactccaccaacccagttatgacaaccaaaaatgtctccagacactgccaatgtcccctaggaaagaaaatcaccccaaggtgagaaccactggtttcactccatctgcccagtgcagcatttgagcataagaaattgtccctggggctcagcttctattttcacatcctcagtgggaccaactagagatgagtttctgtttactttgggaattaggatgtaagctgcatctaatttattatgaattctgcttcatggaaaataggcttcattatggtgttggcaacaataactggattctctactctggattctaattagtatgtaaaaaatatcatttcggggataaaaataaaaagcagattatgtgggactctctctctccccatctctgtctgggttgacatcttcatagccttgaggtaaataaatcagtgttttctccacatatggaatcatgggcatatttttttgttttcctttgtgctattctttattttcaaaactttctgcaataaatatatatcattttttaaatcagaaaaatccttgtgaaaattgagacactaatccacacttagatttctagaagatactagtaatttctttggacaatatgagactctgctttctaattagaacactagtgcaattgtagctccaacaatgatgagacttcttagggagaacttgagtggtggacataggaaaataatatgttatttaatcaggaaaataaaattagagcaatgtcttgaagatttgaaatgccagggacctgcaaaaaaaaaaaaaaatcccatcgccagctttgatttatataatattttcattaaagaacaatggaggacaggaacagcagttgctttgaattacatgctatttgtgatcagcaatagtggattaacaaggttttactgcgtttcagatgtttctcgatgattgattgtcgacattcatatctacatatgcttaccagtctctgggggcacaaactctttgaaacagaggcagatcttttattgattctgcacaagagcagaccacactggagaagccctaatacactggcagaatatttagaccattgatatcagcgtgcagactatttacctcagaatcccaaggccaaggtggaaacagtctgggagcaatgcctacaaaggcttttttatgactagcccctagcaagcacacagctttcccagtcagcaaaggcacttggctccagcttgtcatgaaaatgtgggcatggtctcaggcccggatccgggaaagcagccactgtcctggtccatgagcagacttccatgagcagagcaagaaaccctggctgcaagtctcctagaagccgagaatgtcgtctcctgagtggccccaacaccagttcctgtgtggagaagtgggagaagctttcagactgaggcctgcagaagcaaaattccccaattcccagccaaagaacataatcttgaagtagaaaaacaaatgaaattcatacaaactgaatccaacaattccttttcctcattggaaaggaaatggttgggtgaagattttggatgaacactacacagggccatgactcctttcttcttgcagcagaggccggagtaacggggtcagaaggttcagcttgttggtccctctgattggcagctttctccttggggctccgtgtaccgtcatgagaggcttcgtttggttcttaaattttgttcagcttctggttctttgaccaatagcagcaattggatttcttaaccagaattaaattgttaagtcccttattgcacaagggaggaaacgttctcaagtaattttcattcagatgaaatgggggtaaactggtcttgaaatagttagaaggaaagaattaaaatagtaactctattcccaggtatgtttttctcccgtaggaaacagtggtttaaagtttatggagcaggttaacgagttggagagccttgccttttggcccatgtcctaaaataagacttttaaacacacttcaaaaatatacagcacttctcattaatggcaaataaagaattgagtcttgaatcaggatgtaaaggcagaatgattcatatagtattatgtagcaaaaatgaggtttttcagaaatgaaaaatttcattcattaaatgattcctggaatgctatgggcatttattttgctttgctttttttctctgtgctctttgatatttttcaaatttctcttcaataaatacttattagttgactagagaaaatgaactaagttggaaagttgaaaaattgatgtaatagaaagaagacctttcaagaagtggagagttgtcttcaaaagtctgtagaaaaggaaaaaaaagtttttttgttttggctttacttgaaggcagtgggatggattggaggacttttaagcttgttcttttatgctggttttgtttatcttttgtggctccaaagcagaaaactttgttctctttcctactattaagctaatgggactgcgtataactggaaaacctgagcatctctgagcttgttgttgttgttgttttctcttgatgtcagtttttattcaactgtatctcttgtatcacctgaaccagcacatcgattcatttgtcctacataagatgctgcatgtcagaagagctactaatctgtgggttttatggtgacatatgagagtaggttaggctaaacatcagttgcataaattctttagagcttggaaccaatcttaatagtataaaatacaaatgcaacattgatgccccttccctccctcatttgcttttttcctttcatcatattttcttgcttcaatccctcctctttctctctctgcctttcccatcctttccttacttcgttctttccttccttccttcctttttgtttccctcctcccttcttcctttccttttttagaaaacattcactgaagacatacaacaaactagggactctgttaggcaccagagatattaaaaagtaataattaagcacaatccctaccctcagggagcttatgtactaaagggaaaaaaatcccttaagggaagacaacaatatgtgaatttgtctgaaccgttcaagggagggaggaaggaagaaagaaaagagaagatatgagaggtatacctgggggctaccaaagttttttcaaaaaatagtccccctcccatattctatgaagaataggtctccagtgattagcaaacacataagtattctctcaagttagtcttgggaagaggagcttcatggcaataatgaaagcaatattaataaaatcattcttaacatcagagcactggtatggcagaggtggccataaccagaggcagtgtctcacctcattgtctaatttgagaggtggcagcacccatatttcctgcactgcaagaaagttaaaaaataatcaatctgtgcagtgcaaagaaatatcttgagaaatttaagtaagctccttttagatattttctttcctaatattaagctaatgggactgtgtataactggaaaagctgagcatctttgggcttgatgttattttctcttgaaaataacacacattttatcaattcaatgtaaatttaattaattcaatgcaaatttaattaatttaatgtattaagtcaatgtaaattaagtcaatgtaaatttaattaaattaatttattaaatcaatgtaattttaattaatttaatttattaattaatgtaaatataaaattaacaacattgtctcttaaaaataatacaatttcaacccaaatctctctcttttcacattaataatacttttaacatattataagcaattatgccaaaagattcctgtatctgaattgcatatatgcctagaatccggtattttgcttattggtggtctccagatgctggaggtgtttcttattcccacagccctgcctccctcttgcttgaccttactgatagcgctctggggacacgcagaatatggacccagtgagttggacaatggctacatcatcaacaaacatccaacaagtgacccagtggcctggaagcagaggaaaggacagaaaattggtaggaaggtggcatgagaagattctgtggagaaggaagtttctatcatactggcaggaagaatgaagtggtcatctaggccaggggatgagctctcacacgggagccatgtgcagtgtctggagacacatttggttgtcacgctgggacagagatgctcttggcatctagtgcgtagtgctcagggacgctgctaaacatcctacaatgcacaagacaggtccccacaacaaagaatgatccagcttcaaatgtccaatagtgctgaggtggagaaatcttgctttataaaagagacagaaaagcctgagcgatgatgaaaacagggcatctgaagactttgtcctcagaagtagaggtgaggaagacaaggcatattcaccagatcccggctttcttgtcctgcatgtccatgagggtagaagattgtgcttggcaatctcattaaaccccaaatgcataagcaaccaaagtccataatatcctgcctaaattgaaaatgaaaacttgacacctagactgtaattagcaagaatgaacagcttcctcatttccccaaattcagcagggcattttaacactcagtcatctcatttcctcccagagctgtaaaggtgtcatgatttcagtctccctgcggtggagtttctctgtaacacggagcctggccattccactttggggatgtttttgacggctgtgtccaatggcattaagatgctgtcatgagctgtgttgactttcctccagtcagagctgtccctgaggatttcctggttttaaggacaagccctgaggaagaatgagctgcctttgaaaatcagccttgcccgcttgtgcagtagctctctgaagtcattcacacagagcccacagtgctgcttgtgggttattccagaagcgtctcttcagcctgattccccatggggaacgggaggcctgtggagtttctctctggctgttctccatgcctggggcatttcccatgccaccacctgtgaggacagttgtactcagcaaatgttagcatcgctcgagcaagtccactaagaaaagattgacttggaaatgttaagaatacatgtatttcagggcgtagaaatagaacccaggagggagcaggcagctttatgtttttggcatcaaatccagtggcattgcttaatgaggactgcctctccaatgggatcaagggcttgggctctgcaggctggttggcccccgtgagctccaagattgagggctcatgcactggtacttctgcttccagtcaatcatttgatggtttcaaacatacccttgacagcaaccttctccatttcaggatgtcgggagtgccaggtctgaatgcagggaggaagcaagagacaactgataacagatgctgtgatgtggctaccctccctcctttctctgcctacacccgattctccagggccccagggtcagaagccttgattgagctcatagttccaagttgacagctggaggtttattcttatctgtatctcttgctgcttctcaatctggcctcaccaagatggattcaccctaaggcctgacctggggatttaaacccaaaatattcatctgtgtcaccctctgcattaacttatttattgggtgctgactgcagactccccaaaacagcggggtcaccagaccgctacacagccaactccatttggataggcctgcttccaaatttctaactctggactctgtcttcctcacttgaccctgtcttctctcactctcattcttttggggatgaaagaaaatgggaatagaagggaatcatactttatttggaaaatggataaaacctaatataattgaggttgaagagcaataaagtgaaagctaaaatatgcagaatcattgtcttatttagagacatttgttgtctatgttttaaaaattgctcatcagggtttacattctatcactccaggtgaaagacttatagcagagccagatgatttttcctcctttaattagaaaaatacgtgctctttgtaagtaatgaaacgaccaaagatgtgaaaggaagactaaacgatccacacagccccgcttcctactgcacattgaaaaccattgttaagagctttgtggatgtccttcactgctttctccacattcatgtaaaaagagacaaatacaagtaaccacatttattagttacacgttgctgcattagaaattatccaaacttactggcttgacacaacacatatttattatctcatggtttctgtgggccaggcatctgggcacagtttagctgagtcttctgctcaaggtctcacaaagctgccatcaaggtgtcagctgggctgcattctcatgtgaggcccaactggggaagaatctacttccaagctcactcaggttgttggcagaatttgttttcttgtggctgcagaaatgccagtttcttgcttgctgttggctggaggtcacttcaagtttcagaggacactgagagtttgctgtcacatggctttcacaatatggccacttgcttcttcaaggccagcaatgagagtctctctagtgtgtgctaccaaggtggagttttatataactatatcatgatgtaatatcacaagagtagcatcccataccctttgccatattctactagttagaagcaagttgcagggcctgcccacactcggggtggggggggggcggttatacaagggtgtgaacaccaggaggtagggatcatggggccctcctagtttctagccaccacagcatcccaggtgattcttgtgtacaagagctgtctgcaacactatatagggggttcttggtcattgctgtttgcatttttactcatggcactataccagtgatgaagcctgcagcttgcttttatgactttcatttttttgaggtggagtctcgctctgttgcccaggctggagtgcagtggtgcgatctcggctcactgcaagctccacctcctgggttcacgccactctcctgcctcagcctcccaagtagctgggactacaggaacccgccaccatgcccggctaattttttttctattttttagtagagatggggtttcaccatgttagccaggatggtcttaatctcctgaccttgtgatctgcctgcctcggcctcccaaagtggcttttatgactttttaacagatgtgtagagaatttgtggttccacataaatgacagtgtaactaacctttctggggttgatttacattcagattgtttccagtttttgccactgtagttgatatctttttacataggtgcttaataagtggtacattctagcaggtattggaatactatggtctgtggaccaaatctggcttgttacctgtaatagtttttgcattgttagcaggttgttaaaaaaaaaaaaaatatgtgacagagaccatatgtggtcctcattgcctaaaatatttactatttagccctttacagaaaaagttgccaatttatgtcctatagaataggtttcaacagagtgagaatatcttatgcagtttgcaatttttttttttttaacagagtttcactcttgttgcccaagctggagtgcaatgatgcaatcttggctcactgcatcctccacctcctgggttcaagcgattctcctgcctcagcctcctgcatagctgggattacaggtgcacgccaccatgcctggctaattttttgtatttttagtagaaacggggtttcaccatgttagccaggctggtctcaaactcttgacctcaggtggtccgcccgccttggcctcccaaagtgctgggataacaggtgtgagccaccgcgccccgccagcagtttgcaaatttaataaacattaccagattactttcccaaaatactagtagcgagtcatgctcccccaggaaagtgttgagtgtccagagtcttgatgaatgatggatattattgttccttttcatttcaattaatctggtgggtggcaaattacacgttctattgtttctatttgaatttttagaactagagagattgaacattttttcaaacacttattgttttttttttttttaattttctcttcttgacatgtatattcattctgttccttctttgctcatttttgactggattatgttttcctacattgcgtaaatatgtactaagggttaatatcgaccaggctcaagtgaccaggctccaaattcagcagcgaatgtactctgaaagtcttttaatcattctgtaagatctcttaaaatagaatggatactaatcccaaggaatggttctatattttacttgattagtagtcaaacatatccaacttttcctatttaggaaactctcccctgtcccttatttatgcaaactttcttctaaaatttattttactttttaaaatgatttgactgatctatttgatgattcctgtaccattgccccactattttaataagagggtctttccaatacattttaaaatatcatatggcaagttctccctctttgctctcttttttggttattattgactcctcttaggaatttaattttctaaatgaaccttaaaatcactttagttattctcacatatgagtataattttgaatcttgctttttatctgttctttagattattccatttgtttcattaacagtaacctataaaacaatgttgaatggtactgataaaactgagcattgcttgtttcacccctgatttgaaagaaaatcatgcttgctattgacttgtacaagtaaggtctgttttctccaaataatttccattattcctatttaaataaaatttttattataagtggttgttgaaatgtatcagatttcttttggaaaatctattaatattttatgtatttttctttttttaaaaaagtaattatgttgataggtttcctactattggaatatccttccatgcctagaatcaaccctacctgttaatggtgcttttatctctctcttattctctctctctcaatcattttaaaataatgctggacctaagttgctaatgatgaaattgctatacggatttctagttccatctttatcagggtttagaataaagcttatgccagattcataaagttcattgggaatttttcgtattttgtgtcttttgaaactatttaaatacatagcaagcacctgtttttttaaatgcttggtggaatttagctctaagattattatggcctggtgtataactgttagatcattgccaattactttttcaatatcatctatgattattgttttacttttttcatgttttctactcttttctggccaattttggtaattcatatcttgccaggaaattataatttccctttaaatactttcgcttttcaattgtcattgagtcgcataatgccctctttatagaaaacttccatttctatggttatatatccattttcattcctgacaaaaaatatagaatatttttcttgagaggaactcatctattttatttttattttttaaaagtcaagattattgaggtatactttatatacagtaaaatttgcctttttaagaatacaattcagtgagttttggcaaatgcgtacagttgtgtaactaccactacaatgaagataacatttctgacaccctcaaaagttcccttaggcccttttgtaatgaaccactagccccactggcagcccctggcaatcactgatctattctgtgtctccataattttgctttttgcaggatgacatgtaaatggaattatagaggatgtggattttacttagcataatgtgtttgagttcagacacatatgagtagtatcttcctttttattgctttacttgtgtctttatttatttgatgtaagactttctatgttatctaattttttctgtttttgagacagagtctcactctgtcgcccaggctggagtgcaatggtgctatcccggctcacagcaacctccgcctcccaggttgaagtgattcgtctgccttagcctcccgagtagctgggtttacaggcatgagccaccacatccagctaatttttgtattcttagtagagatggtgtttgactatgttgcccaggctggtctcaaactcccaacctcaggtgatctgcctgccttggtctcccaaagttctgggattacaggcatgagccactgcacccggcccatgttatgtatttcttattgagtgagcttggcagtttgtatcgtatttttttttttttttgagatagagtctcactctgttgcccaggctggagtgcaatggcgtgatctcggctcactgcaatcttggctcacttgaacccacctccagggttcaagtgattctcctgcctcagcctcctgagtagctgggattccaggtgtgcgctaccacgcccggctaatttttgtgtttttagtagagacggggtttcaccatgttggtcaggctggtctcaaattcctgacctcgtgatccacccgcctcggcctctcaaagcgctgggattacaggagtgagccaccgcacccggcttgccgtttgtatctttcaagaaacttttccattcatctaagttgtcaagattttaatattgtcttattatctttttaatgtctataggatttcttgagaggtcctctcatatctgctgttgttaatttttgtttcctttccttttcttcctgttagtctccctagaagattatcaattatattgaaattttcaaaactgagatttttatgacactgattttctctatttttaaaaaattcaattgatttctgcacttactcttaatatttccttccctctgcttgctttgcttttaattttctcttctttttgtaatcacttatggtggaggcttagacaattgaagcacttctttttcttcaataggatcatttaatgtgccaatttaactgcatcctgtacagtttgacatgttatattttaatttttgttcaattcaaaatgttttctaatttccattctgacttcttttatgacccaggggttatttaggaatttttttatttccaaatatttggggatttacatatatcttcacattattgatttctaatttaattctattgtcattaaggtgtatacttagtacaatttcaagtttttaaaaatttgtagaggtttgttctatggcccagaatatagtctaactttctgaatattcaatgattacttgaaacgaaagtattctgcagttatctataatgttaatcaggtcaagtttgttggaaatattggtcacttcctgatgatatttttgtctacttgctctattgattactaagtgaagaatgttgacatctccaaccatgactgtggatttatcctttcttcttcttctgtttctcctcctcctcctcctcctcctcctttttgacattgactcccctctgttgtctaggctggagtgcagtggcacaatctctgctcactgcaacctccacctcctgggttcaagcgattctcatgcctcagcctcccgagtagctggaattacgggtgcctgccaccacatctggctaatttttgtatttttggtaggggtggggttttaccatcttggccaggctggtctcgaactcctgacctcaaatgatctacccactctggcctcccaaagtactgggattacagacatgagccactgtgcccaatctgttgtttcaaatctatcatttttttgcttcatgaattctgaaggtggctcagtccattttatgctgctataacaaaatatttgaggctgggtaatttataaagagtaggaatttattggcttacaattgtggaagctgggacatccatgatctggaggctggcatctggtgaggacattcttgctatgttatcacatagtggaaggcatgcgcacgtaggtgcacacatgtgagagaaagaaggagggagaaagaaggggactgaactcactctttaataacagacccacttccatggtaatggcatcaatccattcatgagggaggagcccttgtggtctaatcatctctcgttaagtcccacctgccaatactgttgtatttgagattcagtttccaacatatgctttttgcagaacacattcaaaccatagcacaaggtctgtttttagatgcatactctttagagttgatagcttttcttggtgaattgacctctttgttatgtgatgtctctctttatccctggaaatgtcccttttttggaagcttactttgctcttcatatagccactccagctttcttttaattagcgtttggatgttattatcttttgctatcctattacttttaacccatctatgccttcattatttaaattgagtttcttatatattgcaaatagcctggagttgttcttgagttactttgggaaatgtggatgtgactaattcatttaaaggggctgaaaagcaataaccctgggaacatggtaacaggttctgaagtgatgaaggacacagaaattggcccatgcaaagaagcagggcagtagcattgagttggtaatctgagataggcattgagtggagttccaagtagaaatccattgctgcctggaaaatccagagatcactctggaaatcaagtcagaaggagttcaaggccagagaacccagctactgaggggaattaaagaaggaggttgagattgtgatactgcaatgcagaatagggagtttgttttccggaaaactgggtggagctaccaaggaggtagggcacttctccaagacaaaagcagatagtgataccttagagcccaccttatttgcatgtgaattatcttaaagtgtagggtgaactgagccagcaagtagcaattatgtaagtgcaatttccaacttagaatttagtgacagaagccaggcaggagatgataaaatacactaatgggcaggcttacttgcccaaattcaaggttttatctttatcagatgacctgtagccactataaagagaggatagaatttgctggaaggtagatgttctagcttttcttttaatattattttttattttgtaaaatataggattgctgcaaatatgaagcgctttttataaacacaagtcttaaaaagagaatggtggaagctgtgggcttaagagaaggttacaaataaaactcattcatgagaaattagaatttcactctaaatttttatagaccacctaccatatggcaaatattgggctaagccagtcctggtctcaaatttcagggatattacagtctaatgggggcaaataaacagaaacggtaaacaaaatgtatacaaatactaggttgcaacagtgacaacactatgaagggaggcataggttgctttttggatcaatattaggggaatttggcttaggcagggagatcaggaaatggtggttgagaggccatctgaaatattggccttagttaggaaggtgagggaaaagtggtccaagtggaggtttgtggctgaccagaacatggctacaacagccagtgtggccagagtgcaggggaaaagaggagaatggtccaagatgacgctgaggagatatgcaagcacaagacaatggaggggcttatcagcaccatggaagagtttcatggaaggtaggtcagaaacttggaaggacttttagtcagtgtatgggggttgggagtgggacgaaaatgatggaaagagtgttccgaagcgtgcatgatgtggtataattcagagattaccttggctgctctgggagaggaattaaaggagaagatgtggtgtagattacaggtagaccagttagcgggttatttcatctatttaatctgtagatgtgtgacatgtgaaagctcatacttggaggttgagtgcagaagtagagagaactcggccagttaaagagatatttaagaaataaaatcaacaggacttggtgatggactggacatggagggtgagagagacatcaaacctgaacctttggtttttggttcatgaacatgattggccaggacaaggttttaagaagagatcatgaatgcagtttggatatgttgaacttgagatggactttaggcacccaaaactgattactgcaaaaaaataggtcaatgtgtagggctgagctcagtggagaaaccagacctagagatttgaatttgggaggcttctgcacaaaatggtgattgagtgatggcgtgaatggcattgcctaaggaaagatttaaaaagaaagaaatggtcaacaccacaaaagctgctgtatgtcaagacgaggtcaagaaaacatctattagaatacgtattgatgtagatgccattttttatttcagtgagcactatcttggtagagtgaagacactgaactcccaatagagtgtgggggagttgattcttcacaatgatcggtgagaatcagaagcagcgggtctgaacagccctttgagaagcttgacagagaagaggaggtaagggagggcagtagttggagggaaaataagattggtgaagaggtaagataagcattattattttgaaatgctttagtgaaaatgaacagcttttaatgaccataataaaaattgaactttgagaataaatagactgtgcaaaagaaccagtgttcattaaatcatttttctgtgctacttctcaattggtaattggttttcggccacgaaatatttgttcattaattgctctgcttcctatttaaccatgctttaatgattctcttaggagaacatggctgaagaagacccaaagagagatcctaattcctttccataaattgcccattactaagatgatagaacaattacaagaaaggttgttctgtaagtccttaaccccatttttattttacatttttgaatgtgcattccgtagtgagcatggtactcaggaaaagggattttgttagtcccacgtctccctttttgtcctcctattataattgtgagcaattgccttcttcaacatatttcacttgtgtatttttttttaaaggcaagatgtgggctaccctgtggagtgtatgacatgcccttcaagttgactttgaaaggtaattaattatggtagtgtctgttcagtttcaaaagttcaaattaaatatccttcaaaactcgtatcaaagggaatatattttacacacctgtcatttgtgagaaaggctgatttgagtcaaaattaggaaggaggtaaagctcatcattagaatgctggcacagccaccctggtctgttgaatgaaccaatcttctaataccccttgagtggccctgtcttaagtacttcattactacttttccaggagttctgtgatttcacagaatttatggtaagtcattgttgaaaggacctttaagagcttacagaggcctagacaagaaggcacatggctgggccctcagtgtgtaaggggatagttagagaataccctgagggctttgagctgccagtccagtaccgtgtccactacagtaggggtcagcaaactacagtccacaggccaaatccagctcaatgcctgtttttgtaaataaagctttattggaacaaaaccacaccccttcattgacatatcctttatgactgctttttctctatagccacagaattgaggagtagttcagtagttgccatagggatagtatgggctgcaaactttaagtattcacgatttgaccctttatagaaaaaaatgctgagccctgtgacttgcattggctgccaatcctggttgcacttcagaattgctaaaaaaaaaaaaaaaaaaaaaaaaaaaaaggaaagaaaagaaaagtacaggctgctgagccatgctcttgtgctcttgattttctcatccctcatctttcaggatgggatccaggaatcctcatttgcagaaaagatggtttaaatgctcagtcatgttaagaatcactgcattacatcctgctctctctaaaagcacattgccttgaaaacacatctcaggtggtaagtgcctttctatatgggctatgagactggaagcagctccccagggcagtgcttcacacacttccactagtatcaaaatcccctggggtgactgctagtcccaccccaaagattctgatcagcaggtctcgggggaggcaggagaactgacagttctaacaagctcgcaggtgatgcagatgctgcagattcctggaccacactttgcatagcactgaccaagaccaaaggcttgcatctctagtgagagaaagtcaggtccatgggatggggttgaggatatatgtatggaccaactgctaggattctcctagatcacactgtaaagactcccagtgctctgttcaaataatcattgctcttctcttcctcaccccatctataagacttgaaatcaagcaaaccttgttctgggtttccacttctatataggctttcttttattgtgttttaaaaattccctggagaatattttgagtgttgcaaaagaattgtattttgaatagggaaaggcaaatagtggatgagagacagtaaaagaaaatgaattatatgtcataaagtagtatgaataaatggtagatgttgaataaatatttgtcaacatcataactgcaaaaacacaaaatgatgaaaaggcaacagagacaggcagagacagagggtcttggtgccacaaaaatgattttattttgaaccagaaaggaacagcaatcaagacaatagtcagggccgagggcttggcagtgtgacttaagtaccggggattgaatttgtccaggtgcaaggagtgacataaagagaatcaatttttcatgtccaagccaagctgatacagatgatgatacttatcagtgattcccatttacacaggcttggattgcttttcagatatcagatttttggaactattttataaatatttttaaaggtgatggagccactggagtgtaggtgaattggtgcccctccccttttctttttgggtgtatcaagcatataatcaatgacaggaaaagtgaaaggtttttatgagagttttgcattaaaagaaaaccaacgatcaagtttctacactgcagcactgttgatatttgagcaagacaactcttcgtggtcgggggctgcgcttgcactgtaggatgtttaacggcgtccatgacctctacgcactagatgctggtagcttcccttccccggctgcgacaaccaaaagttgccattgcattgccaaatgtctcctggggggcaaaatcgagcactggttgagaagcgctgttttcaaaaacatcctcctgcccccatcattgtcttggtgtgctttttaccattttattaagatagaccagatggtcaacttcccaacaccaaatgcacatgtatgccagcatatatgcgtgtctctttgcaggtatctgcatgttcctggagctgagatggaattccacggtcactggaggacgttagttcagttcctcagcaagtttaaggtcaatatatcagtaccgtaataaaaaagcctgtctgtattcaagctgtttcttttcctccagcagaaaccatcgtcaatatttgcagtcagtttttgaagtcactttcttttaaagctggaaagaatcttcacccaggcccaccctcatcttaatccactatttagagtcctacttgaatgatatcgccagcaactttcaactttggatccagatttctttatttgtatccaccaggaagagaggtaccacgtttctgagttcttttatgagcactcgctatgtaatttgcaaggcccagtgcgaagtgaaaacgcaggccccttgttcaaaaattgttaagaatttcaagacatcaacagcagagcattaaatcaggcttagggcccttctgaactcctgggctctgggcatacccatgacaccagacctggcagtcttggttggtgctgcattgattttgttgtattaatttaattggcactgccatctcttttgcccctgtatcgcagtgtttcctgtggtgaggaccccaaataataaaatactgtgacctcaatcagtttaaagagaatgcaaaattacactgcagcaaatttttacagcatacattttttagactttcaaaaaaaaaattcacacgggaatcttttctacatcattatagtaattaaacacggtggcctttcaccatatacatattttcctgtaaatatgacaacctggaactagtaactgctactatccacaatgcttttaagttagccaagagtgagacttccacaacaaaattatgacataatctctcatgtccttataaaaatagccaaacataccctaaatggcttactgtgaaaatttgagtagtaacttcttaatattgaaaaacattattttcatggaaatattgtccttctactaagtgttttatgttaacatcataaggcaaactgtagcatttattggtacctggagaccgtgattttaaaaactcagaagctgagttttagacccttttatttagaacctgttagtgtacaaagtgcattaaaatatccattatccagttacccaaaatgtatgtaaaaattactgagacaaccctttcagtttactcagagaaggcaaacacacattgcttttatattgtaataaaaagaaaaacctataaggtttccagagaaagattgttttttttccattgaggcgtccatcttttagatgtgaaattgtcttaggtatctatcaaaatattcatctgggtataaataatatagtaaatatatagaatctatctgttaagaaaaaggagagtgtctgctagggaagaggatggaaggacccaggaagctggcttggcctcccttgaaatccagatttgcaatcacatgacctttggccacgtgatgctgaaacaatgagttcattgacttatttcagggaggcagttggttgatttggttaaaaacaaaataactaaaaacaatgtctaaatccactagtctgctcagtcaaaatggctgacccagtatcccaggtaaatattttagcaattgaaaccatttatagaggtcatgcccttcatcaaactagaaccaatgccagagttctgggccaagaactgctcaagaaagccttaattcatggaccattccaacgcatcagattggcatgcaaagaatcccagctgacattttataagcaggttcctgaataacgagtttgaattttttttttttttttttggtcttacaactctattgtaaactatactagactatagagggacttctacatctttcaagatgtgtttaataaaggtctgtttataataacttttgaggcatgaatctagcaaatagtactttatacaatgtcccttgtcattaccaactcataaatattaagtgtttttcagtgacttatgtttggatgtggtagtgctgatcagggccatgtgctgatgtcctggagagcaaaatcaatccaaagtggtgctgctatttgtgacagaacatgtttatttactcagccccggagacaaaaggaaaattgatatgggggagcgggaaataggagaactattaaatgtagtgaagaaatttcacaggtctaaaggaactattaaaaggaaggataaagtagattctatactataaaacagaatcctacctctgataaaagacaaatcagcctgaatttttgaataatcaataggattcaaaatgactattttcaattgcaatctcattcttaatgttcttccagaacccttaaccctgagagaagcagggcaaaatgtggccaaaggattcagaacctttctttccaacattatcccatcagctatgagaaggtaaagatttagccacggcaaggtccgaggtccaaaatcaactcttttcattctctgtcttgctctccattttagttgatctgatacaactttttgacatcacaattaaaacacttcaaattaaaccagagtaagaaagcctgtttcctcccctactaggttcaaacacatcctgttatgcaccatcgaggtgagaagacctaccatgggatcatcatgggatatcaggtaagaagatgagtaacatacaaaactacaaaagtttttgtttttttgtaagcccacagattgtgatgaaatgaaggttgtaaatagctgataaacttatgggcctcttaatgtgcaaaaccaagtaattcctaaaagttgtaatcctgattatgtttctcttataaataatctatagattttcctctaaatacaaaaaaattaaagaaattattaaagcccgtacttaatacaagacacagtaaaaggagaggaatctcttgttttgagccctatctgagccgatttcgggacacttctggtgagatttcattacactcatgaagcctgtgctttctcagtcccctaaatagtggcctgaaccttactgttccccagaaagcagctccatgtggccagacgctcacggcagctgctctgtgcagtccaaatggtctgggatagggagcccagtgataatcgtcagacacttgttccacacggtgaaggtggggcaaacaggctgcgcaaatgcgacgtcgaaggtgtagaggtggatggagttcaaagcatcataaaaggcgatagagccgttatcatagtccagcaggatgcccacgcgccggaggtggggggcaggctcaatggggatttccttgctattgtgtctcaccacccagttattgttgcagcggcagagcgcccaggaagcagagttcttcccaatccattcatgcttcggggctgatttgtaagcaagaccaatggcatacctgcggaaacaaaacagcaacaacaaaaacaatgagccatgttgcacatgcacgttaaatccgttctgtggtcctcaggggttataaaaacatgatcatttgttgtccctgttcattttctttaagtgaaagcttggcaagaaccccaacatctgtgttcctcatctccttccctcccaaacatggaaagtgggtggaaagtagtgggtggaaagaagcgtcgtatttacccacatttctgttttcagctcaaacactacggagaatttgaactttgagttttgctgctttttttcactcttataaaaatctacacaatgaattcgctagaccagtgctgaccaaaagaactttcttcaatgactgaaatgttctgctctcctcgatatggtaaccacaagccacatatggctactgggcactttagctgcggctggtgagactgaggaactgaactttaaatttatttaattttcattaagttaaatgatttaaatagctgcctgtggctcatagctaccatactggacagcacaaccctagacttctccttttgaccttcttataatttttcatttaacaccatgtctgtcattttctgattctgaatgcactttgccaagggcaagcacagaagatgattcccatttgcagggataaatcctttgtcattactcagccccaattttctcatgtatattgagaaatatacagtgttattttaaggagtaaaggagagaatacatgttaagtcccaggcacaggacctggcatgtaatattcagtaactgctatttattttattattattgcctgatggcacatattaacaataagtaccagaatcagaatttgaactcaggatgactcaaaacccacaaacacgaactacattctacaatgccatccgtaaccagaaattgtgcagttcatcactgccaagagcctttctgattatactggaaaaaaaattctgaacgtgtttgagcagacggatcttctggttattctaaatgttctcttgctgctcaaaaaaatccaaagaatgctttctacaatgttctaagcatcttaatctctttttacccctctgagtcatgcctctgtaatattcatcgtatttcagttattaagataaacaaaacccatcactctttataaagagtaaatgactcacagttgaacttttaatatgttatagcagaaaccagtctaattggatattaacatatggtaccttacccaatgcagagagaaaaatttcatgggtctttaataaaatgacattctttaaaaaaaatcacactggacttaaaatacaatcactttaagagtggtgtgtttgtttaaaaagaaaattaacacaacatgccatcactaaatccaaaagaaggatggaattgataatctgccaagcccagtgtgcaggcctgtctgtcatcaatgttgcatcctctcttccctcccgtccatcctctcctgcttatgaggagaatccaagttgcatttcccagaatcccctttcctgtaggagtctgggtcaggctctgctattgtgatgcctttgcacaagatccagaagtgcttagaggaggggaaacacgctttcctgatggcagacagtagacgtgcggttggtggaagcttctagatgagcgcctgagtacacctgccttgtgctgtgggcaactttgcagcagctacagctcatcatgactccatgaactagagcagcagactccctgacttcatgccccagcccttccagggtcctgtaagcttctggctcccttctgtggcatgcatcgagggtctcaaatgtcatctgtttatttgatacactgatatggtttggctgtgtccccacccaaatctcatcttgaattcccacatgttgtgggagggacccggtggaaggaaattgaatcatgggggcaggtcctttcagtgttgttctcgtgatagtgaataagtctcatgagatctgatggttttaaaacgggggagtttccctgcacaagctctctttttgcctgctgccatccatgtaagacgggacttgttcctccttgccttctgccatgattgtgggctttcccagccacatagaactgtaagtaagtaagtccattataaacctcttttgcaaattgcctggtcttggttatgtctttaccagcagcatgaaaacagactaatacatacattttggaaaggttttcattttgcaattgtcagtatctcccaccccccaaaaatgttctgtataccccagtgaatactatttccgcttttcagacaatttggaacctgcatcacaaaatcaccacatctgtattgtttccttcttgttgtggcacagcatttttattttttattactttgatgtttatttcccatttgaaccttaactgaaccctatgaaatagctgtggcaggtatggctgactacatgtagcaagtagaaacagaagattaaaattgggagcaaaatccagagttgtatgctgcccccaccccttctggtctaataatctttgcatgaacccgttattactcatttagttaacaccatttcataaaacaccaagtgcacattagcattagagagtaagaaaatactaagtgtatagtccattaagcaaaggaaaataccattatagtatcattaatctgtgaaactaggtacatatttccattgagcttgaaatgtgcaggcagaatgtaatgttccattaagttacgcagtgagacacggagaattcaaagtataaaaattatgtctctcggagcaatgttaacgtgccccattgcacagatcataatgtacacatcaatttaaagtcaggactatatttcataagcaaatatgtcattagctgttgcaagtcaagatgtcacaggcatttaatcgtagggggtgccccttccttgctaataccccccaaggaaatgtaaagtgactttctacatgaagatttttctgaaattgacaccgtcaggtttgtaaagattaattgtgtagcaattaattttagaatttcttttccccctcatgagttagttttgacatctggagggtgttttcaaggtaatgctgatgtgtgtttatataactgaagtggtctgatggaattttgcaaactattcatcaatggcaatgagatcataatgatcaggtttcatttatcataattaattattaatagagtaataatcatttagaccctggattctatcccagattaatacagcacattaattaactagaaacatttgctttttttgtacctgcatccattgtgttttcctttgtgctttaattttgccccactgcagctaaaaattgcaaatgccaatctagcccagagcctagtggggtgaaggatttgtcctccatcctctggcaggatgttggaacagaaaactcttctaggcaaagagaattatgaggatagcaacaaaggaaaacctactcgctcagccaatatagtatgtaccattattgggagagatgggaagcttacaattcacttcttagatttttggctaatttctacctacaatataaaggactcagccatgtcacattatttgcataggtttgaattgaaaggtttttttatatataaataagtgttttatcatgcttatattgaaagaaacactgttatactcaccatcttcaggctatgcaattttgaatgttgattttattttttaaagcaaggattcagctatcactcattacgtacactgtcataaaccctagagagtaattatagcatttcaaaaatataccacccttttgtgaatagcagcataccatggtggttaagagcggggaacagcaaactactacccaggggccaactctggccctctgcctgtttttataaatgaagttttattggaacgcagccatgtccatttgtgtaggtgttgtctgtggctgctttcccactacaacagaagagtcgagtattagtgacaaaaatcatttggcatgcaaaaccagaaatattgaatctctggccctttacagataatgtttgtggactgctggttaagagcctgacccttgactgcagacttactgactctgccacctgtgagctttgtaaccctgtgatcttcagcatatacctcagtcacctcatcagtaaagtggataatattagcacctacctttgtagggctgtaaggctgaataaatgagttgacatctgtaaaatgcttagaccagtgcctggcacatacttgtaccatatgagggcttgttaaataaaaataaaatagctccctttttgatcaatagcaagcaggcatttgtgagacagacggtcaaaggggtgcagttgtggctgtggattaggcaaggttaactttgtgaggttaactaattccaatgtaattgtgtcctgacctttgcccttattcttagagaactcagtgggctaaagtcactgggctggatctaacaggccttttgaaattattcccagcctatgatcactgcttcacccccaccattcaacccttagctatttgcactaattggtccagtctagaaccataaaacatacaaggcaacagaaattagttttgtgtaatgatgaagagtgatgtttaaaagtagggaatggcaaactttttctggaaaggaccagaaagtaagtaaatatttttggcttcgtagaccatatgattctctcttaactactcgattctgctgttgtggctgaaaggcagccatggactatatgtaaaaaaatggacctggctgtattcccataaaactttatttacaaaaccaggtagcaggccaggtttggctcatgggctgtggtttgccaacccatgtttcatggcatgaaagagcagtgttaacatggtatagctcatccaatgatcagagctctataatcttgaacagagaacccacaggtgtgggtattagtaatatatggttgttgtttgaatctgctgagtttgggggtgtttgttatgcagtattatcctagcaagagctgactaatacaacttttctgcattttattctttaagatgcattacagtatgggttgactctctaagtacagaatgagatgtgcctttttataactgcaggacaatagaaataagttgcttaccatgtgcttccacttatgaccacttcccaataatgccggccactatcaataaacacatttccagctactccatagctcccctggctggtgaagcgttcaggtgtgtgactcttcttggatgatgactcatcacgttctactgtcaagttatcatgggacaccttcagttttcgatgagcagatttgggatccagtttaaatggttggcctgaaaacaaattcacaaaacagaaaaaggaagaggaagaggattgtttattttatcataaccaatagcatattttcaaaatcaggtttaaaagacaggaacaagccagccctccctgagtcatgcctcctatcacaaagtggtatcttatattttaatagtaatttaaacattataagcaactttcaaagacatttgcttgcaaagttttcataatattcaaaagacaatagagagcagcaactctgtgtatagtacagtacacagtaagagtgaaaaagaacatgttcctgtcttcataagctttcagtctaccagttctaagatagggatccagtggtggcatgccaactattcaacaacagcatggataaggcttagccagaaaacatagggtgagctagcttcacggattccaggtgtatacaagcagcacaggtacatactggctggatagcatcctgaaaaggaggaatgaatgaagactccattttcaaccactgcagtgttctatccagcataagatgcattcatgctcaatagacttcagaccagaaaccaaacaaatcaagatcttgggtcttaacatatagaatattctagaggtttatattattctgagattattaaaaattaaagcattactcttaggaatttaggatgagaatacaattttcaggccacaaaattaggaaaaaatgtgatagcaatgcctgggttttctactcatgaaattatttatatataataaggccttctctatttcattactcacatttgtgtcttaaagatttaagtattaaaaaaatcttggcagagtcacacctggacattttgtcatagttgttacttcttctttgacaattcaatattggtttggagtactgcctgtcattcaacactgcattgggtacaaggcgtttaaaggcaggaaatgcattgcaacctgatacaaatgccatggtgtccaaactccacagtcactgttgcagttggcaggttccttctgcccagtatacagctctcaatcacaggaaaaggtctagtaaattcaactgtggcaatacacgatgctgggcgagaaactgacccagtgagtataggacagtgtgtgttgtcacatgtgggtaggccaaaggatttccagttgccttttggatacaaacacaacacaacaccagcacctctaaaatcctttctttttaggtcacggaccagcatactttttctgcaaagggcctgacagtaaatatttttggctatgcaggccaggccatgtggtctcttttgtgactattcaactcttctgctatagtgagggggcagccacggacaggacaataggtaaatgaatgggtgtggctatatgctaataaaactttatttacaaaatcaggcagccagatttggcccttgagctatagttagctggcttttgttttagaaatctatttctgtacatatcaaagaaaagcttaggctgggctggtggctcatgcctgtaatgcctgcactttgagaggccaaggcagctcgattgcctgaggtcaggagttcaagaccagcttggccaacatggtaaaaccccatctctactaaaaatacaaaaattagctgggtgtggtggcggacacctgtaattccagctacttgggaggctgagccacgagtatcacttgaacccgggaggcggaggttgcaatgagccaagaccatgccgctgcgctccagcctgggcaacagagtgaggcactgtctcaaaaaaataacaataaaaaagaaaagaaaagctttaaagggggagcagagaaaaccctcaagggctgagcagggattggacattctcagaggccgtaagatctattggattacatgtgtagtttaaattttgacttgtaaaaagaagtccttaggaatgatcatgctagcaactatcagagataaactatgaactaagacaagaagagtatgaagacagttttgcttaaaatatttcaatttttaaaggtggaaggtagaatatggattaaaaatgattgataggatactaatgggcagagcaggaagaaattccttaatggcgcccatcatttacaatgaaggccaagttctgctcggcctccttccggtgagatatatcagaatgtcagagccattggaaagaccggccttgtgatggtgacatactgcctcaaacatcctgcctgccttggctcacaccctcacccacgcatgtgtggagcagaatcatgcaatcttggtgagcaaattctgcccatgcctcagatatgtttcccaaataaaccactacctactctgcccaaattcaaggcttttgcttcagtgaagacaaattagttcaagaaagagattaatagcttactttactaaataattcaattcattataatatttgtatgggacacgactcttattcaggccgttgtttacttacatggacaactctttcaataatcttttgatactgtgcccagcagccagtcttccttccttgtaatccactcaccacatcatagtgcaagagagctttatttcatggaaattttcatcctgcctgtttgatttaaactcttcaatctctccaccaatcattggtatacaaagaaactccctggtgtggcccaggaggctttcgcgatctgttcttgtctccagcctcctggctcacctatcctcccaacctaagacacactttaaccacatggatcaattttctgttccataaatatattctccttgtctctgggcttttgcccatgctgttccttctgcatggaacactgtgtcctcacatcccctgctcctaacctaccttggaaagcctctcaaggttgtgctggggcaccctggctttgtcaacttagaacctctcatggttattccagtcagagatttcacatattgaatgttaattaggattaatgtgctttattccccaatagtctaggacctttttgagagagaagcacaccttagggagttgaagatactcataatatccttagcatcttgcacagcatcccaaacacacttggtgctcaaacatatcttttgaaggaacaaatatttacatgttcaaatgcaaatcaaataatgctgatctaagtgtgcataggtattgtgccatttgttgtatgactgtaaagaaatatatcatcatgttatattctcttatgtacttttagaattactttgagagggtctttttgacaactcataacaaccctcaagttgttaaaatattcccattttaaaactgaaggaacactaaatgcattgtgggatcctggattgggtcccggaataggaaaggaacattagtggaaagctggtaaaatctgaataaagtctggagtttagttatgagtaattcatcaatgttaatttcttagttatgataactgtaccaaggttacataagatgttaatatttgggcaaactgggttaagggtgtacagaactctctgtattatctatggatttcctgtaaatctacagctattccaaaataaaaaatctatttaaaaatatgaagaaactagccatatagctatatgggtaccaagtgggaaagccacagtcttctcattcgtaattcagtgctctctttacatcccttgttcttcctctaggatccaacacattcctctaggatacaacacttgtactgagaaacaaggatataggttaaatgagggttccccttgaaaagcacttaattgttcctgttgactgcctggcaacctcacaacatggcgccataccgacacactccaatttgctttctcttgggaggtcttatgcaaataaacaccatgttacataacataatattcctagatcaaaaggatgtaaagaaagaagagaggataaaacaaaacacatgtggacagagagagggagatgacagtatcatgagacacacatataggccagaccattctctgtgatgcgcactgtcctgtggattggggatgtttcccatcatccctggcctctactcactacatgccggtagcatccacctcagatgtgacaactaaaaacctcttccagatattactaaatgtcctggtagggtggggtggagggggaggaagaagtgtccctgattgagaaccacagactccgactgttttctagaataaaagaatttctgaagagtgattagttggctactctgctatgaaaaataacactatccaccatttacagagcccctactgtgtgtcaggtcttacatatacatcatctacttctcacaagaatgcctccaggaatatttatttaaaaaatgagaagactcaattttttaaaattgagtaatgcagagagagtaatggcctcacggctgtgaaggaatagaatcagttttggaacctagaggtatctgatgcaaattccattattccacactggctttttacttgttttggggggctgtcaatgatacccaagacagagaaaaggaaaagaaagggggacagagtcagctgaaagaagagcagataagacatgacagctctgttgagttcacagcacttactgtttgtcttcaacttcccaggctcactgctgcggctgcccgcctggttgatggccttgaccatgaagatgtacttggtgccgctctgcagaccgtgcaccgtgtagtggttctgcttgatgttgggtactatcatccagctatcagccgaattacacagacctgcaaagccaatcagacatggtgcagttctttggcacaaggggagcaatgtttgcataattttaggttgaataatttccatttatttgaatagagttggtaagtgaagtgctttgtcttggtagtcatgtacgaaaaactgacttcactaacgtagatgtggcagattgcatttttgcctccaaaattctccctgccctgtatatccaggcccaaataactttgcaggtgctccttctaaagaggtgcaatatatttccctgtcatgtggctttgaatttggtcaagtgacttgctttggtcaatagcatgaggctgaaatgacaatgtgctagttgcaagagtaggcatgacaaaaccttgagggtttctgttgaccctttgtgtctgccactgctctggagaaaatatgcctaggatactctgtttatcccaacaggatgagacagggaacagctttaccatgcagccaacgcccagccagtgcaggagtgaaccaagcagcgatcagccaaccccaaccgacctccaacagggaagctaagaaatgatcatcatccctaggatgactggtttcagagtggagtggggctgttgctctggctgcatcctgcaggatgtgggttggggagcagaccgagtatttatgatgcttggaagaatatgtaggaaaaggaagcccatcttgttttgcagctggttgatggctgaaaacatctctttggtatcaggtccaactcccctctctcctttttccacccatcaatctccactccaatagaacctttttccaaacccttggtgaccaggctgtcaagaagtttcctgactctgttgaatttccttcactgatccctgggagagggctgggccccctccacttccagaggactccaaagccaccaccccactcctctttcaattgatttgcaagtcaaagggttagttcctttgatcttgaggcaacttatactttaccagattctcaagaagcagtcccttaatctttttttggtctcacctctttgataatctaataaaacctttctgtagtaagaaattcacaaatgcatatacacaccaaaccacaaatatatgcatagaatttcaaggtagtcacaggctcccgaagcctgtctttgaatcttactgaatacttacttactccatcttttgagttaaaaattattcatggtattgtcacagttgaaaaattcaccttatatgatttccatcttgggtgcataatattttcaagtacacatcagtgaattaaatatatatatatatatatgtatgtatgtatatatcatctaaagatatctaaagatacacacacacacacacacacacacacacatatttggtcttgtgaattttctgttgcctttttttttttttttctctaacctgcaaacattttcgccagtggactgccagatttgaaaaagccagcttgaagcaagaatgtaatttaggactcatagaagggtttgagtgtgtgtgtgtttatatttggagattcagcagagcaataagaggcacaatccatccctcctccccaaatttattttctctaattcttagccctctgttttcctaccaattctcatttgcatatgatgcaggaaaacatccacaaatagtttagtaacatgggaatctccttactatatatcccttctgatcttccttcaccttaccttttccttgaacatagctataataaactccatacttctggataatgccacagccaaatattagattttgatccaatcaaagaagggtcattttgaactctgagttctgggccccaagaggcctataactctctttaggtacttaatattattacagtagtaataaaacaaaaaattagcttttctattatgtaggatagtgtactcatattcctagatctttgtcaatggcagtcagccacgaatgagaacaattaaggcattcagtagattcaaatgagaatcgtatcaatttcactgcctttatactgttcctgtttaattgaatatgttacaaaaaaatgactattgtggtcaaagaaagcaagtgtaaaaatgtttcaataaactttacatcactgtacaacccaaaagctgggtttaatgtggtgggggaacgctttcagtaacatcataaagcagatgtctgaaattgctgaaaactgtaacttggcctaaaatccaaagtcttaacccaacaaagattttatgtttcagaaaccttttccaaacaaaaagggactctgactatcctgattattttgaagaggtccctattttttccttgaaaattaaaagaacaaaatgtttatgaagtagtaaaatttcattggttagctttatactgggacaatctactttcatgaatactaacaaacactattactgtttaggtttacctttatgttattattattgccaagataataattgagaagttgattaaaaatgccaggaaagcaacattgacaattttcttctgggggctggagtaagtggggtgacttggagtgcaccattaccggtgttggtcttacgccagcaccacctaacttcttgcatatggcactgagtttgcttaagcaagacttctctgccttgacaccccactgtgttaggactcttgaccaggctttattcatctctttatgaaacacccacacaaccatcctgattgaaacttcacttttctccaaactcattttcagtcatctttgagggtgttccaacattcacctcctccgactcagtttaaaataacaacggagcttggaaaataatttgtccacaatgaaacctaattaattgagttttttgattttatacattttttttttcattcacaatgggttagaagcatttccctacataatgtggctcattataagatcttaattacatctgggatttcagagccttgtatggcaactgtcatcttgccacaaaaaattatgtgtaaaaatgtcacatgatgtggacagtcttaggagaggctgcacactggtttctaacatcctttgtctcttccaacagactggacagaagtgaacattcctttccttctcctctgtaaaaatagtatatgtttaataattttcatgaatgttttctaagtgactacaataaattaaaaacagataactacttagccattaaggcttgaaaaaaatgcagcttttgatttctgctaagaataagaataggctgctggggaaaggacccaatttaagacttaaaatgaagcatcaaaagtagttttagagaaaacgtggcaaacgttgtaaaattaaataaatatctagttattgataagcaattcattaacatctatagtcataactctattaacaaaaataaaaaataaaaattaatgtcattacttttgcatttgaatgtatgtatttcattagtgagggccttttcgtaagattgaaaaagctccatagatattatctaagtctccttcactaacgccagttgaaggcaattaactacaatttattaggatgagtgaaggaaccatgacctagagacagtaaaagattttctagtgatataaggagctacagccaggttttgagcattatatcttctcattttcagtagagttttaccattagaccttgtcacgcaatacaacatctgcaaaggatacttctccaaataataggacagattatttaacatcattcaaggaaagcctttcacatactgattgtgtaaaaagctatcatgtagataatcctggaaaattgcaaaactggtctttcttttaaaatgcaattatggggtgagtacagtccgtatttttgtaggaataataactttgaatatctatgtgctaccactgtggcaaacacaagactaaggtgtttactattattatctcaaccatgtgaagttaaaacactatcccttcttacagatgaggaaacggattcggaggacattaaataatttgctcaagactgcagagctagtgaggtccaaagtcaagattgaaatccaggtctcctttggtcactacaaatgtgaaaaatatttaagaagaaaataatttgaaaatctttgcctatcggttagctttttatctgaatgaattctttctttgtcgcaaatggatcctgtaggcattaggacttcactattctggtttaatgggcatcaagggaggaacacatcctgatacaaacaacccggtgagagtatcccagtttggtcagcaccagcagtttcactgtttttcttccatcctgggagaatgggcctttctggcatctatgcgttaaaggctgataatcttcactaagccatttgcatttcttttcttatggcaactggtttctgggaacaaaacatctctggaatcacccaacataaagttctgagttcattatactgagtggttttgctcttgttgagtttttttatgcatgacctttttgcatcatctattctattaatgcatcatgtttggtattattttcgatgcaaatagcacagaaatcaagttggtcacagtttagccaagtgagaaaccctaagtttcaagcaataaatatcttcctttcattttggggatgaggtgaagctctggtattgagttagggccttttggccccaattccttgctccttccttgtaattttgcaggtctttgcattctcactctgggctcacccaggggacgtctttgacaaacctcatgttagctaatgtgacacagacaggggcttaaaaagaatgtgtgtaattggtcctgcctttactccttcatctctgcaatcagggtgagagcagacttgagctggattgtaggaggatgagacagatgtgcagcagtcgggttgccacagttatcagtctgccatgtgagggagccaagatcagcagggcttcctagttgacactcagttgactccagatgcataagcaatatgaattctacttaggccctgtggttgttggctattcagcaaaagccaacggatacagagcccatcagtcaaggccaaggctacatgtactcccaaagtgtccatgacgatttgatttaagaaatttcaggagagggctgggtgcagtggctcatgcctgtaatcccaacactttgggaggccaaggtgggtggatcacttgaggccaggagttgagaccagcctggccaacatggcgaaatcccatctctactaaaaatacaaaaattagccaggcgtggtagcacatgtttgtaatcccagctactcaggaggctgaggcaggagaatcatttgaactctgggggtggaggttgtagtgagccgagatcatgacactgcactccagcctgggcagcagagcaagactgtctgaaattttatatatatatatatatatatatatatacacacacacacacacacacacacacacacacacacacacacacacatacatatatgaaagaataaaagaaaaccaaaagaaatttcaggagagacataaccatctgaggaagacatgccctaggatggtccccaggattccaactccctggtattcataactgtgtaatattatctccttagtgtaaacaggacctgtcatctgcttctaaccaacagaatatggcaaaggacaaaggtctatcacttttattactcctgtttttatattacattatatgacaaaggcgaaggcgaagggagtttacagatataattaaggtccctaattatttgatttggagctaatcaaatggcagattattctgggtgagtctgacctagtcaagtgagtcctttaaagacaggtttggaggtgacagatttgaagtagcagactctctcccttgctggccttgacgaagcaagctgccatgaattccacaaccacaatgaaacaaatttgtcaacaaatggagggagctaagaagtagattcttccttagttgagtctccagatgaatgcagcccagccaacaccttaatttcagactgtgacaccctaagaagaagacccagctcaactatgccagaatcctaacccatggaaactgaaataataagtgggtattgttttaaactgctaagtttttggaaatttgtttcacagcaatagaaaactgttagcacttttcctgaatcagacgaaaatgatttgagagaaatatagcatttctcacatgggccaagaaccactcttttggtataaaatgactccaaatgttttctttttccggttagactattcactcatcaacagacgttggttctatcagtcctctatgtattttcagagaaccttccttggtgttttacaatgaatcatctctccattttctacctgctcttctcagaccttcacgtgcttcttttctcttaccttggaatttctgatcatcttttgaatttcatcttcttcaagtttgatacaatccctggttcagtttatcccaaatatgctagtgatattaatcacaaaatattgagaaaacaattccttaagtgaagacaaaatacattaattatattcccccctttttgttgtgtttttccttccatgctacatagtatagtagtgtgtgtggatcagtgtgttatggtctcagtatttagcatgtaatcatgtagatattatacatttaccttgttttaaattagggtttctcaacttcgacattactgacattttgggccagatagttctctgttgttgggggatttcttgtgcattgtgggagatttcccatctttcctcacttctacccactagatgccaatagcaccctcctcctaggttttgagaaccaaaagtctctagagacattgtcaaatgtcccttagggggcaaaactgcccttgttgagaatcactgcttatatgaaggagtgactatttagtatgatattagtgatcatagattaacttgtgtttcaggtttatggtgaagcacaatcaaggtttaaaattttactagactttaattccacgttaagtttatggtatatgtagccaagatcagtgaaatacaataagctcatacagctggaaaaatgcatttaaaaatcatgtcatctctctgaagggcaatttggcaatgtcaagtaaaattaaatgcaaataatcttttcctagaaattgcacctcaagagattatactacagatataattccccgtgtgtggaaggagagatattcaaggatatcttgaacatccttggggatactggggcattgtttgtaagggccaaagattggaaacaagctaaataaacatctatagaagatgggataaataaattagagcatatctttaaaataggatatgatactgcctcaaaaaggaatgaggcagttctttatttgtgctgaaatggaatgatatctcagacataatatttattgaaaaaaacaaggtaaagcattgtgtatgatatgcacatgtagaaaaatattttagagaattagtatttctttatgatttgcagtagggcatatagagtcagaaatgaggaatgataccagaagaattcaaaatcctagaaggtgagcaaaatgttactaaaccattgctatacaggccttctgcgacttgccccaaaaagcacttcaaatatctgaggacactgatgattttttcccaggaaaatgggccagacgcagagaagtcttcctggaattatcttttcctttccatctctgatgctggtgccatttgcaggtcctggctatttctgcctcagtgaattactacgaaacttcccagctgatgtctctgcttctggtcctgccctgttcctctccactctccacagtgctcctgagtcaccttctagttatacctctgattacattactgtcctgcatgactctcaagcccacagggtaaaatccaaacatggtatggcctgggtagccctctgcaatctagctcttgcctgtgaattaggattaggtgactgaggattaaggattaagaacatgtgctttttggagctaggccaatataggtttgagccctggttctatttctctatcttcatttctcactgtctccctttcctcacttaccagccaggcttaattaggcaagacctcccactatgccctgctacgttacatcttgatagatttgcttatgatgacatagctgtccggtacagccttaacttgctaaaatgcacccgctttttttcaagacttagtttaaccacaacttcccccaagacatttttgtcccactcaccatttctgacctttctatattccctactgactcaggcagcttgccagagctgttcttgacattgcatgactttctccactttcatttaaaaattacacattcttggtaaatggcaagattttaataaaagcttccacggcaggccaattatagggtagaaggtgagggagttgaggagaggaagttggagaagttggggagagtggatataaggaaggtagggggagccatttgttggtatgggtcatttatactttagtcccttagaacttggtgtatttctgcatcactcttttaattaatcctaaatcaaatttctatgttaagcatcgtatgactcagaattacttgtgctaggaaagagcagtttgtagttaagagagaaaaggtttatataataaaagcacattaaattgatatgaatttattcaaaacatctctttgttgaaacatgactgctattctattctgttctattttgacatattgtatttttctttgttaaagaagtttcaagcttgctcccgtgaaaagccatgtcttctggtccattgccatttgcccagttcaatttaaataactctgtgggttggaggactgcttcctctgttatcatctctgtggcctgctactactgctatttgaaatcaccaagttatctctgatgccagatatcaaataggcctcagtgagagggggcacctctaatgtttcaggtaaggttggaaattcttcccgggtggggccagttactaacattttaagtgatgggcccagctctctcctctgaatgggaccaggtatttaactttctttggctatttattttattaaatcctttcttttaaaatatgtgaagtaacactcaggaaagtacataaaactaaatgtatgataaaatgactaaagcatgtaactttcacctagaaattgccattaaccccaagaacccctgtatatttctttccagtggtgccacttgccctttaatcctggaggtagccatcatcctgactttttatttttatttttttgagacagcattctcactgttgccccggctggagtactgtagtgtgatctctgcccactgcaacctctgcttcttgggctcaagccatcctcctgcctcagcctcctgagtagttgggactacaggtgtgtgtcaccacaccccgctaatttttgtattttttttgtattttttgtagagatggggtttcaccaggttgcccagggtttatagttttaacacctatgaatgtttctttaagcaaaatagtttattttgatctttaagttatgaacctatatgtggattaatactatatatatatatttgtttctctctctatgtatctctctatatatttgtttctctctatatatttgtttctggcttctttcccttaacatccatgtggtttgctagaggtcattaattttcatcaatatttagccagctgtttttactaatgtagtacaagtgagtgctatcacttttttgttcaagaaagacaagtcaataaatattgtgtgttctttccttccttgtcttcctttgaagtttaaattcaggaatgcaatcaatctgaagaaagccaccaaagacagaaataaataggccatgagatactcactaacgacgttggcttgtccggtgaatatggtgtactggagctcgtaggagaccacgctgaactcatcatcggaggtccaatgcacagtgatggtgtcatatgaagctgtgcagagctcttctctaattgtgggagggttgggagctgtgggggtcaagaatgcttatcagtggaaaagcacacacaactgggataccatttcagaggagatgtttgacagttaagcaggtccttctcaataggtccatcaggactactatcctagagatggtgaccccaatctaaagaatatctgattggctggttattgcttttgtttttaataaggagtgtgactagagtcagccagtatggactttctgtgtttatcatgagatcatgagaatatgtttgggaggttaaacaaataatactttcttgtgcatgaaggaaaacttgtcaaataaaaagtaaacaagataaagtttcatagctgcattcactttgggaggttggctaactttttcagtaaaggccttgatggtaaatgtttccagctttgtgggccatacagtctctgttgcaactagtcaactctgccattgtagcatgaaaacagtcacaacttatacatgtgggcatggccaggttccaataaaactttatttacaaatataggtagagggtcagatttgggctgtaacccaaagttcaccaacccctgacctattaatacgtggtgccagatacttatatctttaggcacccaattgaaaaaatacttatgtttgttatcctacaaaaaatcagccacataattgtttgaatttttctttcattagatgtttcgatgacttacataaaaaaaagaacttactagtccagccctattttcttctcatttctcaactcatgcgatatttcaaattcagaagaccatgattcatagtcaatcatatctaaaaggtacattttccttccccaaggaaaaaacttttttttggcatttggttaatttatcattgtagaaggctgctgttttatttctttaacacattctggagcagagaagtctaagtcctaccaaaataatgagtttaaaatgacttctactgaattgatttcagtaactggttttatgagaagagtatgtgagcaaggaaaatatgagaaaatgagtgctttgcattgtaaataatattttagagggaggggttggcaaactgtgactgtgggccaagtctggcccactgcctgtttttgtaaataaagttttattggaacacagccagattcattcatttatgtattgtctatggctgctttggagcaacagcaaagttgagtagttgtggccatatggactgcaaagcctaaagtgtctactatctggtggtttgcagtcaaagtttgctgacctctggtttagagaattgatccagggcctttacttccactcttctacccactagaatctcacttcaaaaggagaaacatacctgcactctacaaactaggagcaacctttgcttgtactatttcagagttatttcctgctctaaattatgattagaattgatgagtcctaagcaaacccaaagaggaagaaaagtttataaaaactgtaaatttaaactctgcgttagtagtcttcactttgctttttgaatatacctctaggacaagtatcacagaagcaagtctacggtattaagtcaattagcttagctttatctattggttctgaattccagaaacattgttgagcacctccaacgtgacaggcatggcattaaattgtgcattaagacagaagggttctacataacctttaaagcattctttctggaatatgtatttgtacatctgtctcctgaagtattcacatgtgagatttagtgtcatgtggtatgacttggatgtgcatgaatcagtgacaccaatcaggatatgcattccacggaggaggtccagctgcatcgtaaaatgtgcttattattgtctgtgtggtccctgttggtgtgggatcactcctgcatggaccagtgaagaaatacttactctctcacaatttaaacagttcattgaattatttctccatcaaccattgtagaaaaattttgttctgtattgcaatatacaattaaatagaaagaaaacgtatgttcaaaataggcaagtagctgtgagacacatggtagtagccataatcaggaaggaaatgtcacctctatgggttattaacttgatataccacttagaggcatgtcataggaaaaaaaaaatcttgtttttacaatgagacaggctaaccttattttgactgtaaacccaatgagtttgtcctgagaagtcaatactcaatttagtgtaaatgagaacagcagcatgctgccaatttcaatactcatggaatcagtaccagaagtgttattttcttgtctctgtcacaaacaccacccaaggaatggtgggctaatactccacaaagacttcatttcctgcttacaaatgtcataaactatttggacttggcagtatcagccaagcatcatatgttatggtcaggatcgatgttatgtctagaaatggactgaatttgtatttggggttgacagctcagaagacataatagcaggtaccccatatggcctttagtttgaaataaacagccatcgggatgaaatatggtgtatgttacaattcagtctaaactactttcacaatttcccctttaatcaatacttttgcattcctatagagattaaaatgggtatatgttgttgaaatactatgaaataattattgggaaatggcaagggcacattcttgtcaataagactgattctgggcagaatggccatgtgcctaggcaaatacttaattttccagtcttttctgtccctggacatgaccttgtaacacagatacagcccaccagacataagtggaagtttgctaggcgggtcttctgatcaagctttttgtttttctgataaacaaacttcactggcagagcattttgtccatcgtttcccctccacccctttctttttgcctagagcttgagcacaacacttggaggtggagtagtcatgttgtgatcatgtggcaaaaaggcaacacaatgaaggcggcagaggaggaaaaaagaaagagcctggggtctgaggtcgtcactgaaccactgcccagccctggaacacaggcttctcttctgtgactgtaatacaaacactccttgatggttttattcactgctagttggattttttgttgcttgcaactaaactcattcgcaaatgatataagaaaaaggagatttttaacaggatgccactgtgaaaaacagcttagctggagaaagtctagacctgcactgttcaatacaatagccacgagctacatgtggtggtttaaatttcaattaaatttagttgaagttaaataaaagtaaaaattcactagccacatttcaagttttcaatagccccatgtgggaggcagctaacgctggatagtacagatatagaacatatctatcatcatagaaagttttattggatagtgtcagtttaaataaatctcagagttaaaagcttaaataggagggcattatgtacacaaatatttgaaaccaagtttagttccatacggtaaatgcttttttagtcaatttctttcttccttaataggagtggtatgtttgaaagagagagttacataagataagaagtttgtggaatgcctgcctgccttgcttgacaatgcagaaaggctaaaaacggcacattgggtcctcgcaaagaaaaaatgctcatcttctgggtacaatgctccctgaatatagaacccctggccttctatccacagactgtaaaaacaaacatcacacaatgttccctttctcctgctccaccttgttcaatcgctttctcacaaacatgtacacacagaattggaattgagaagctcatgtcacgctaagttagagacgtggtctcttgaaggctgtatgtcttaagtgcagcgcacatctggcttcactgtgtacattgtgctttcctgaagtcgcaggcactggtggctttggctaacacgaataaggttgtctaaacagtccaggttctaccagtgaatattctcagttcctactttagaagttgacagcaaagaaaagtttagaagcatgcttaggaataggagtggcctgaggtttttgttgttttgttgttgtttttgttttttaagctcaaccaagggagaaacaaaacaaaacaaaacaccaaccaggaagcacactgaaacacagcactaggaattccaatgtaaatttgtgacctttgccatggtgacatttgccaagataaaattcagtcttttactagaaagagcagaagtttttggagtttgtacaggtcccagccaaattctaattctgtcattccctagttacctgatttccagcaagacggctgatctctgtcatttgcaaaatggggattataatgctttacctcaactcgatgttgtgcaaattaaaacaagatcacaaatacaaggagatgaagcagtacagacaaccaatcagttagctgccaattttttctctgccaatgtattgtgagttgcttactactatgatatgaaaaataccacagagagatactatttttagcacccacaccttgagagtgagggaaacagtggtaagtatgcttttaatggttgagattctcctttttctcctgtccccagtttagtaatgggctgtgttgttttgatgaaaaaacaaagggcaatgcacagaaattgtttatggaaatatcagtgccattcctaggtcaaaagcccattcctctggttattggggaataactgatctggtggcaaagtgtttatatcactaagtgtgcacaatattaaagagaacataaaagacaatacctgtaaggtaatccagacattctagcagtttcttctctcgggaaaaatctaaggcaaaggtgtcaaatgtgtcattgaggttgatttcaggaattagaacctgggaggatgcagttgccatggagactctgtaatgcaaacaaaacaatgtttcagaaatgtcaagatgactttcaacatcactgcatagaaatgaaaaagaaaaggaaaataaatatctcttaaaaagtgcttttttacacatgagttttaagaggcatctcaaaatgtcacaacacagtaacataaaacaaatgaatgcaagctttaaaaaaaagtgaaggaattggagaaaacaacaaaatggcttgccctcttcctttttactatcaggaaaaaaaattccctgcgaaagcaaaagaatattcatatttcatgttgctgtgtatttaacagtctggcccggtcacgtctaaccccagcaagaagcgcgtagctctaggcatttcttcacacatctgtctgggaaactgtttgttcctttcagacgcaaccctgatccacttcaaaggagagtctccaaaatttcaaactgcataaaaggcaaagtgaatattaaaaaagaatgtttccagatattggattagtttaatcaattactagcctctctctaaaataaacattaaaaagggagttttttgtctggctcattttctttctctttgtattcattttcttgcaccatattcccagcagatgctgtggaaaatattcatgagctttctcacaaatccccccagtggatgcactatttctcttcttcatttaggttttctggttagagttctcatgtataaactaaaaagcaaggcactggtgtgtctcaatctccttctatgtactctcaggttcatttggaaggttcagttattaataatgaacactttgattcaaaaatgcaagtgcttctcttaaaaacaagagaattgtggcatgaagcataccatttctgagcatatcaaatgatgctggactagtaatcttgttgagtttggtattttgttaagttccataaacaacactcttaagagctattatatgcggagtattgcgtaggatgctgggaatttttgagcaaagaaacaaccttgaaacaatttagtactaaatctagttacttattttctaattaagaaaattgatgctcatttatacaaggccacaaagctagctggcagcagcaaggaggagaatttcagatctgtactcttctgtttcatctagaaaaatttcaggccagttactccaagggttatatgtccttttgagtctcttaatggctcttaaagctttggatttacaaatgtaatatatcttggctctaaaaattacatctgtgggtatatatctatacaacaggatattattcagccataaaaagggatgaaacactgacacacgctacgatgtggataaagcctaaaaacattatgctctgtgaaagaagccatcaaaaaggccacatattgtatgatccatttgtatgaaatgtccaaaaaaggcaaaaattcataaagacagggagtagattggtggttgctaggggctaagaggggaggggagatggggagtaactgcttaatgagtataaggcttacttttggtatgatggaagtgttttggaacttgatagaggtggtggctacacaacaatgtgaatgtcctaaatgccactgaatcgtgcattcagaagcagagtctcactatgttgcccaggttggtcttgaactcctgggcccaagcgatcaccctttgggaggccttggcctcccaaagtgctgggattacaggtatgagccaccacacccagccttaaaatggttaattttatgttgtgtaaatttcacccatctaaaaaagaatatacctgtaaaatgctcaaaattcatagaaatacagtttctatagttgtatttctggcagattttcagtgttgtacaggagggaaggagagagcctaatcaacaatgtcataaatgtaatgatactgggattgagagatgcaagtgaagaggtctaagctctggaaacgagtttcaagtgtctgaatgagggtagagaatctaactgcatctcctgaccctttcaccaagaagtagtgaatagcagagttgagtgcttttgttgactaaatattgcaccctggggaattgggctaattattgttaccaacagctgctaatttagactgatggatacggagatggttgctaggcatttttgattgatggtcaagttatactttaaaaatgctttccttatgacccatgaacacaaaaagtccttaaacttcatagaggtcctaggattattctcaacaaatatttatgaagcccttaaactatgctacacaccaaagagcccagaatatatgcattcgatgcagaaaagttaaaagaaatgctaaggtgccatttgaacccttaaaagatatcgcaaagtgaaacgccaattaattctccatcataatgtctggcagggagaactgttctgagctactgggaaacaagcaccaaacttgcaattgcatttccctggctttagcagtttccctgcccactggcagaaacctctttattcagtctcatccaaaatagattttgttcccaagtttctcctggttccatggtctacaaacaattaaataaaacattttaaattgagtgacactgttaataatgtctaccatcttgatggtaggaactttgttacatgggaaccaaaaggatcaaagttcctagcctgggaggtaaaggctgacagcaagaatcagtggagattactgcagcttttaacacctacacatttgttttttgatggaaggaaagatacttatctttggctacaacttcaaattcctaattggagtgacaggcaaggggaaatctgccaaattcaacattttaggccatgtttttatttcccaaatccttattgcccatcttctggccttttggataagttgccaaatccactagggctgttagcgctatgccactttctcaacttcttgctttacagccatgtctgggacacatggggccagttttccagaaggtggacgtgtctggagctatgctgctcacaaggcttctgccaaacaatgtgcatcaccaaagtaaaacccagtgaggcctcacagtaacaagataggtttactttggtcagcccaggaattcccaaacacatttggccttgaaaacgtgcagttatcttaatgcctatgaacaccctgcagacacacttccaaaaccactgatcagatatgctctaattctttgaaccaagcaacatcttttcagaattgacaactggagttcttggctttgtattctggaaaagatccttgaactgcctattgtagtgaggaacagaaggatcaccttgaggagtctgagaacctcctaggtgctttgaacaataggtactattcagagggaagtttctttttatcaccttcttgatacagataagttactgctataagggattttaattctagattcttcataagcagaccaactttcttatgcctggacttagtgaatagctttgcttatttaaaataatgctataaaggtgcatatacaatcacaccaaagacctatctactagtgtagcttgagaatatagtacattatacatttgcattcatctagtgagtgggaaggaagagaactagtatttgttgcatgttcatcttgtgacagaaactaggctaatgtttttactacattattgcattttatccccacaataaccatcttaggtaggaataattagtcccgtcttacagatttatggatccattcattcattcactcattcactcatgtcaggcagctcgcaatgtgctggggctataatggtaaaaacaaggtggctagggtacctgcctacttggagtatatgagcaaaattagccaatgttaatgagcagcctcaatgctatctataattactaagcaattagcacagagccaaacaaccggttccaaagcaaaagcatctcctacaatgtaaagcttgaggctctctccccttttggagttgtttgatgtttctgaaatgaaagaaaaatttacagttttgattcagcttgtaggaggacatatccactttaagtcgcttaacgatgcagaaaatctcatctaagtctcacttcaagaatgcctgcgggattaaaagtttgttctgggctccacacctgaattgaagaataaagattgtttggaagtatacaggagccaaagcccaaggcaggcacaataggagacagaaaaaagaagtcatgtcctagagaagaatgttaagtgacaggttgatgaataggggcaggtagacagagagtagcattggaaaaaagacacacaaggcgggctagactgacatgttgaaacgtgaaaacagagatccaactaacactcatggagtagctataatgctaatgacctgttcttaggaacttaaagcaatgtcatcacaacagtgacagctattctgaaaccaatttttttaaataatttttttattagtaaaaacaattcttttgtgggtatatagtaggtgtttatatttatggagtacatgagatattttgatacaggcatgcaatgtgaaataagcacatcacagagaataagttatcaatcccctcaagcatttatcctttgggttacaaacaatccagttacatttttaagtttttttttaaacatacgattaagttattattgactatagtcaccctattgtgctaccaaatagtaggtcttattcattctttcttttttcccattaaccatccctacccacccccactcccacaactccctactatacttcccagcctctggtaaccatccttctactctctatgtccgtgagttcaatcgttttgatttttagattccacaaataagtgacagcatgcaatgtttgtctttctgtgcctggcttagttcacttaatgatctgcagttccatccatgttgttgcaaataactagatctcatccttttttatggttgactagtactccattgtatatatgtaccacattttctttattcattcatctgttgatggacacttaggttgcttccaaatcttagctattgtaaaagtgctgcagcaaacacaggagtgaggatatctcttctatatactgatttcgtttcttttgggtatgtacctagcagtaggattgctggattatatgatagcttaatttttggatttttgaggaacctccaaactgttcctgaacccaattttctaagtagaaaatagctcaaagacccatagttaaaaagtggcagtgctaggactggaacccaggtctgccaacttctagtctaagcccagtgtcctttttctatatcctagctgctggaaggatagaaaggctcaggaattagccaagaggattgacaaatagtgatgggaggagaggggactgcagaaacagagacaaggctcttggcaaatttttacaggctctgtgaattcaaacttgacagaagcacattctttgtagaaagagaaatcaaagtcatgttcctgctcttgatgagttgggcttgttatagagagagctgaatgggagcagatacgtcccactggaactgagggagattgtatgtgggcattcccacacctgtgctatacttcagatgcatatcttctttcagcaataactgttatggggtcacatcatccctggtcactaggtaagaatttattcatgtgacacttggttgaatcttcagggattgatgaggaatgcagttcataatagccatttcatctggacatctcaaagttcatagatggagaaaagtactcctggattccggttggaaaccgtgacctaagtgtaaacgctatctattagtgtcctaggtacactggagtattagtgctatttgcagtttttaactttagggtgaatattgagcaactggatatggcccagggaaaataaacatttggaaccaaggaatcaggaggaaagaaatgggcctctcagagtaaggaggagagcatcttaagtacataacagggatgatagccagctgttatccatgccttttagaagagataagtatctaatcagctacaaaaggaattttcctcaaatataagaaataatacagtcaagccgattggacagtagaccagagttgtaaaaacacgatacattactctttaagaagagtgaaaatggagatgtcaatcactcctcctctatgcgatattttgagaattagcacaagtttccgaaacaagcaagcactcaataaatgttagtttcctttctctttctttgaataaatttgagtcataagatggcgagtattttttttcctaggccaggggttggcaaagtatggtctactgcctgtttttgtaatggttttattggcacacagccacacccatttgtttctatattatctatggccgctttagagctagctacaatggcagagttgagtagctgtgaccaagaccttacaacctgcaaagcggaaaaatatttacttgatgatcctttatagaaaaagtctgctgatctctgctctaggatgaagatcagcatgcatgagctctctggggtcttctagagataggattctattattgctttggataaagggcagttgactctgaaaattagaatgaatgaagtcaaggccattagcctgagttagagatgtcatttatgtggcattggctgtacctggcccagcctagtgcttctctttgttttttcatttatttattttttttggagaaagagtctcgctctgttgcccaggctgaagtgcagtggcacgatctcggctcactgcaacctccgcctcccaggttcaagcaattctcctgcctcagcctcccaagtagctgggattacaggcgcctgccaccacgcctagctaatttttgtatttttttttttagcagggaccaggtttcaccatgttagtcaggctggtctcgaactcctgacctcaggtgatccacccgccttggcctcccaaagtgctgggattacaggcgtgagccaccgtgcccggctagtgcttttctttggatccactagaattgctataggtgtttgtgtcagtgaagatgagcaatttttataccaaccaagtatgtgtgccgaaaaaatacttatctttgccagttttactgctgagccaaccattcagataacatcacattaaagctccctacctgagaataaagagtattttaaaagaagcccgtatgaggttgacagtttggtcctttctctcctgcgtgagttggccttgaccttttcaggtgaggccaagctcctcaaccaaatgaaaatgggcctaacagagaacaacacctgtgtgattttaaaaaaaaatagatgagccctgtgatggaagaaaatattccctttaatgtttttgccttcattttgactctttgttatcaagtgtacgataacatcacatctgagagtcacaataaatgctgtttttgtgccatcataagctcccccctcgtccaaaagcaggttgattttattctttctaactggtggactcttgtttcaaaggccttgaactccagactccaggctgttactgaaagggctttcacatgtcaaaaggaagcatctttagctggaacaaaacagctcaaagcctctattctctctggtactgagccttgaaaatgaaaataaaagcaaggcgagggcaagaccaaccaatcacagcgcagatacaagagcccagcagccgagaaattcccaggggcccctgcactcacctctcggtgatattcttagcagtctgtaggaaacgcgcatgatcattctccttcagagagtgttccgcttgggagatgagtgatgctgaccgctcaatgcactgtttgcagtttgcaatctgctgagccagtttgcgaagcctcatcaccttgaacaaaagaggcatggagagagatggttacatgggtggtcttgcttaatgaaaaggcatcaggctggatccttcattttgttgtgttatccttccataaaagttcaaaaagtaggcatagagatatatcaaaatatggaaagctccgttatgggactctggtttagatattccttatctcattggagaagcattgctaattcgttttacgaggaaacactgaattgtgaattgcttccctgttgatgggaaaaaaaggtgttgcccagtggcaacttacaaagggtcaccagacgtcttccctggactattccacacaatgactgcaagactgtagggaaccctggaactttctctatctcaggtttatcttcttttcatcaagaagataaaacatctttataggtggtgaatctatggtttaaatgaaaaccattttctaaaaagtgttttttgtaattcatgtaataaaatcgagaatggaaagcattaagtgttactatttcccacactacctaaaactcatgtgttaaattaacagaaagggagcatttttcccattgattaatatttttcctgttgagcagatgagagaaagccaaaaaaagcacagctgggccatttcccctcactgggaacgtcatttccaggcactttgtgcttacttgataactaggaactattttgataagcatttcccagttgggataaaaacgcatgattgcttcacaacctccattccaattcctgattctgtctcgcttgaaaatgtccctcaaacataattgaccataacctccggggcaggccaagataagtccaaggtaacccacttgaccgttcgctcttgtgtttgaaatgtgctgtgagatgaagtcctctagccagaagccaagttaaaattagacagctaattggaattgctgtgtgcctactgcccccaaccacacacccagggacaggtttcaaccggctttatgataattctggaatggaaaatagccctgggtgaaagggtacggaggagaccagtcaatctgtcttacagacaaggctggcccaaggctctctccagaattcctgctaattccaagaaattctttctttctccaagtcgtcattaccatccctgtataactctaatctaagaaaaggaaggaaagagatgtcagaacttgaggcctctaaggaacatccaattccaagtatgtactataagcaaacaaaggaaattcatactgaattagaagcagcaggcacaagatttcaggcaagggtgaaaaaaattcctgaaagagtcagagaatgaagtgtcaaaactttagggcaaataatataggatcgtgagcctggtaaaagacttaatgcattataattatagttactgtccccagtggattaattgtattcattagtggaataaaataacacttattttacaccaaatagaatttagcctctggcatcattctatctggaggcaaagctaaggaaggcatccagtacgcgcaggatattagaacatgttcataagaaactgtcagaggaaggaaaattccagaaggaaaactaatttacagtccacaggacaaaccaagtgaatggaatatttaatcacacagcataaagaatcatttaaattacatggccgaattgcagatgtttaatacaattccagcaaaagaaaataaggtcaaaatattcctttagaataacttcatgacaactacttatcctttagatatgcctattaaagaccacacacatttcaaatgcgatgatgcttgaactccagtttcttcttttctttttctatcatgatattgaacattaaaagtgacataacaggaaaaagaataaaagagccctaaatcatgcaaaaattaaagcaagacaaaatgagagtcgcctgtgaaaatatcggaatgttctacagagaacaattttgggcataattttagttataggttagtgtacaatttcatctgatacatctgatttgagctttgcaaacctagtgtaaaagaatcagctgggcatcattttgaaagaaaaacagtagatgtttgggtctacgctccaatatttgagttaaggagttgtaattcgcagagcaggaggaatttccatttcaacaagcaacaaatgtttttaagcctgcaggtgatgaatcattaggacagtcaggactagcctttaaaaaaccaaatagaagaggagaaaagcaaatagcagagtgcattcctggtagaaaaggcaagttgggttttgtaaaaccttttgtgtgtgtgcatgcgtgcacgctgtattgtgatgtcatatatatttcttactgcgggttacagtaaaaaaaaaaagaaaaaagaaaaacactgctctaagttaggtgttcctaggctgtgatctgtgggccaaatcagcatacagcctgtttgtgtaaataaagctttattggcatactaccacactcattggttacacataatctatggctgctttcttgctacaatgttgtgcagaagtgagttgctgcaacagagaccgtatggcaaagcctaaaatatttgttatctggcccttgacagaaaagtcggctaacccctggcttaaatgattacagtcagatggccctgatttgcagcacactctgaaacactgtcctacttgtcacagcacttcaaactcagacacccagcatggagcgaagtacttagttttctattagacaacactttttaatgtattatttttaaaagttgacaaggtgaataaaatttgatgtttaaaaaaattagatactgacacataaaaagattctgtatgtgtctgccttaatgctgcaagggaaatattttccagtcaactcttcatttttcctttgggaagtgagattaccacattgcaacttttggaatttactctctactagtcatggaaatagtttgcctgctggaatctccttttagcagggacacagggctgtttatatcattttatttgctgtttattataccttacacattcttttaaaagccgctttattttgcttgaaatgcgttttaaacacttatttttatataaatctttttatatgtatgtaggatacacaacccaaaacaattaggtccaaacaatgcatcctcaattcacacaagtatctgaactgaaaatgaggcctgttctcaccatctctttaaggccatggagagctcaacatttagtccaagttaattttcttaaacttttaagatttagtgtacataaaaggcagtgaagaaaagggacccttattttgttgagctttggccttcagaagtctaccatagatctctgtgtctgaacattaaatgaatgaactcaatctgaatttagctctttgtgtgttgacatgaaacttatccccgactactgaaaaaaagaagaaaattcttttccagggagcctcatggcttaagactctccagtccgcccacctataaaggctgtcgagttaatttgtttcagagaatgtacaatggtccaagagcaggaatcatcagtaggtactaacgtgtaataatatcacctgcttggtgacctcgtcaattgcagaatttgaggtgagtttgacagctgagtgactagtgtcagagatagacaggggcaaaataaggcagttgatgaaactcacttttgtgatctccacaattctgcctggttcttgctccacctgcccacttccaattgcttgtcagaaggccccaccatccgttctttagactcaatgccctcagttgccactgccatcctggggtgcagggacccaagtcccccagtgaaccccaagtccacacttgccctccctgtctggcacctcagatttccacgggttggcattcacacccttcctcttaaaaacaggcctctgacacaatatgccctggctagggacttgagtcactgtgagtttcagggtttggaatgaactagtccttggtcatgtgccaaagtactagctcaagagaaaaggagtgcggccctcatctttcccaagtaacatctgctttctaagattgccttctgagataatgttgctgagcaaatgtatactttttaaaaagtgaagcattccatacatacaaaaaatttaagaatataatgaactgtcctgtacatagtaccaggtttactaaatctcagtattttcatcatatgagcttcagagttttcaaaaggaagtaaaaaagatttttttttgagacagggtcttgctctgtcacccaggctggagtgtagtagcatgattacggatcactgcagctttgaccttccaggctcaagcaatcctcctgcctcagccacctgactagctgagatcacaggcacatgccactacacccggctaatttttatttttatttttattttttgtagtgatggggaaccactatgttgcccaggctggtctcaaactcctgggctcaagtgatcctctcgccttggcctcccaaagtgctgggattataggcatgagccaccacacctggtggtaaaatattattgatagcattaaagcctctgtgtggcactttataatctcactcatgtctctctccagaagaaaagaccctctcaaatttagagctgatcactcccaaacatgtttatgtacacatacctaaacaatgtatgggattttttggtagtttattaaattttatataatgcttgtacaaataattatataactttcttctgtttttgtgatttgtccgtgctaatacatatcaccctagttcattaattttaatttctgaagactttttcattatataatacacaatttatatgtctaataaacagctgaattgagatagaatttacatatcataaacagtacatacttaaagtgcaaatttgacactttttcaaatatgtatgcacccatgaaacagtcaccacagtcaagataataaacatatatatcatgccccacaatttactcctgcccctttgtaattaactgtgcccatcctttcctgtcatcccatccctaaaagcaatcattgatttgctttttgtcactgtagattagtagaaagtgccgtttctcgaatttcatatgaatctactcatacagaatatactactttctgtctgactcctttcacgcaccttaattatactgagatccatccatgttgttgcattataactagtgtaactagtttattcctttttattgccaaagagtatttcattgtgtgattatgacacaaattgtttacccattcatctgttgatggactttgggccatttctagtttggggctattacaagtaaaattaacatgaaatttcacctacaagtcttttttttttttttttttggatagggtctcactctatcacccgggctggagtgtagtggcatcatttcagctcactgcaacctctgcttcttgggctcaagcgattctccagcctcagcctcctgtgtagctgggattacaggagtgagccaccaacacctggctaatttttgtgttttttgtagagacagggtttcaccatgttgcctaggctggtctcaaactcctgagctcaaagcaatccacctgcctcggcctcccaaagtgctgggattacaggtgtgagccaccgtgaccagtctcacctacaagttttgtatggacatagctttcctttctcttggtaaatacctaaatggctggatcatatggtaagtgtatgcttacttaagaaactgccagctttccagcatgtactactttaattcccacctccagcagtttgtgagaggctctggttccttcacatttttgccaacacttggtatgcgccatcttttgaattttaattattctagtaggtaggaagcagtatctcattgaaatttattttgcatttcattaatgactaatgatactgaaccatcttttcacgtgcttatttaccatctgtgatggttaatactgagtgccaacttgattggattgaaggatgcaagtattgatcctgggtgtgtctgtgagggtgttgccaaaggacattaacacttgagtcagtgggctggggaaggcagacccacccttaattgggtgggcaccatctaatcagctgccagcgaatataagcaggcagaaaaacatgaaaaggcaagactggcttagcctccccgtctacatctttctcccatgctggatgcttcctgccctcgaacatcggactccaagttcttcagttttgagagtcggactggctctccctgctagcttgcagacggcctattgtgggactttgtgattgtgtaagttaatacttaataaactcctctctctctatatatatatatcctattagttctgtcgctctagagaaccctaagtaatacatcatccacacctcttctttggtaaagttttcaaatcttttatgcattttggtgaaaggcttgttttcttattaatgagttttgagaatttgttatatattctggatacaatcctttattaaaataaataatttgtaaatattttcgcctagtttgtggttggtcttttcagtctcttaacagtgcattctgaagaggtttttaattttgatgaaacccaacatataaatattttcttttatggataatgcttttgtcatctgtatgtaaagaatctttgcctaacccaaggtcaagatctcctccacgttttcttctaggagttttacagcttttaccttttacatttagatatataatcaattttgagtaaagtcttgtatataatgtgaagtatggatcaaacttcatattcttacatacagatatccaattgctccagcaccagttactaaaaagacaatcctttctccactgaaattgcctttgcatctttgttgaaaatcacttgtccatatatgtatgaatctacttctcaagtctttttgctgatcctttgatctatttgtctatctttatacaaataccaccttatattgatttctgaagccttataataaatcttgaaatcagctgatgttagttctccaactttgttattattttcaaagtttttttttttttttttgagacagagtctctctctgtcgcccgggccggagtgcagtggcgcaatctcggctcactgcaaactccgcctcccggattcacgccattctcctgcctcagcctcctgagtagctgggactacaggctcctgccaccatgtctggcttattttttgtatttttagtagagacggggtttcaccgtgttagccaggatggtctcgatctcctgacctcgtgatccgcccgcctcggcttcccaaagtgctgggattataggtgtgagccaccgcacccggtctatttttcaaagttttaaatgattatgctatatcctttgcattctaatatgaactttagaatcggcttgtcaatttctgcaaaataacctgctggaattttcattgagattatgttgaatctacaggttgatgtggaaagaacagaaatcataacttttctgagtctttaccccataacatgatacatggcttcattttttagtcgtctttaatttctctcagcaatattttgtagttttcaaggtctttcaagtctcacccatcttttgttagatttatcactaagtatttcatatttgtgaggctgttttaaatggaatttctttttttaaatttcaattttcaattgttactaatatattgaaatgaaattggcttttgtattgtgatcttattctatgtcagatgtttcagtctttgctttatggttgtttttttaaaattgtttggtctaaaaagaaaaatccctcctactctgggatcatatgtatgttttctgttaatgtggttctgttaacagatattctgtagttgagccatccttgtattataagaataaaggctattttgatgtgtttaataaaacactgatggattacattttctcatattaaaaaaaatttttgtgtctatattcatgggtgatattctctcactctagattttttaatgttgtatgtatttggtatcaagatcatacactctacataaaatgtcttttttctattttctgaagtagtttatatgagaatgagattattagttcctggaacttctgttaaagtaagctatagaactgtgggaggctggtgccattttggggcagaaatgcaagttgatggacattttcaatgacttattaaatgtcttctgcttttaaatttttggtttattcaggttttccgctacttctttatgtaagttttcaaattattggcatgaagacatttacacaattttcttatgtttaaaaaagtctctactgtatttatggtatatttgtttatggggccccacactcttttttccttcatcaaccttaactacagattggtcttttaaattattttttacaagtaaaactcctcctgattaagggctggcaaacttttcctgtagaggaccagatagtcaatattttaggctttgaagaccacatactgtctctgtcacacatatattgtttttctttattttttttaacaaccttttaaaaatgggggaaaaggcactttttttattcacagatgtttcaaaattaggctgcgagttgttctttgctgacagctgttcttgtttgtttcctgtttttctttcatttacttttcttcctttatttctttcctctgctttcactgggtttatcctgttgtgctttttctagctttatttgaaagctaattttttacttttagtattaccttttttgggggtggggggacagggtcttgccgtgttgcccaggctggtcttgaactcctggactcaagcaatcctcctgcctcggcctcccaaagcgttgggactacaggtgtgagctaccatgcccagcctctttttcaaaagaattaaagcctgtaagtttgccttcagatacttttttgctgcttactacttatgatatattatagttcttttactgtggtttacttctacatttaaaaaatattactgtgaagatatatttatatatgaatagattttagtgtcaaaaaactatagaaactattattttattgttgataatatctaatgagatacagtgtgtggtcttagaggcagggttctatggtattcagtttttgaaatttgctgaaatacttgctttcaaccaagtgcatgattattattttaaaaatgccccatgtgtaggttttcctatatactttcctatcttttgagttcaaactcagtcggcatttgtcaaactttaatgtcactcagacgtaaaagaatgcgttttatggcattcccaaggtggtgaccaaaactcagtttccaaatttccactgcagctgagttttctttctaatttcaatatctatatttttccctccaaaactgctaatttgttgctttcctatctatttttttatttcatttccttcttttgtggcttcactttttttgctcttttgaaagagaagttattccttcatttctttctttgaacatcttaagactacttcttttaaagtctttttcttattttcctataaaattaattttatctggggtaagataatgttgtctgctgattttgctggctgtatgtttagaaatttaagatttctttatatactttgaaattaaacttagagtttcagttttaaagggaagtaatttataattctttcctctctcaccctccttgctcagcctaccctgctctgatagttttccagttgccttcacctggcccttgaggtcattattcaggaatcccatccttatctctgtgctcctgttctgtgtgggtatcagaaacagtgtgaacacaggcttcaagctaacaatgtgactttgctaaaagctatgatatgagggaaaggttggcaataatttttgactgaagcatgaagccttctatagcccatggcattaaataatgagcctgatttccattccccatcccatctggagcacttctaggtcctttccccaaagcttcaagaactatttatccacaggagctaaagccaaagctactttggcctcttccagaccaaatcccagtagcctgtatcctcagccacagtcatggcttttcagttttgtctcatttctggcctgtggagatgtttatcttgtttttggttcagctatatgtctttgcttttgcattttattaagttctttattactgacatgtatttggggtagaacgagtgcaccgaagcataaactccatgcatcactatggctggaacttggggacacctgcactactctgatctagctcatgagagaaaccctggtggtgggaagtccaagctaagtaagagaagggaaggcaagctagccaggaagttgtggtggagtgcccttgcaggctgaataagggctctcaatgctgcccacatcctaatctcaggaatctttgaatatgttactcacatggcaaaagggactttacagacatgattaaggatcacgagatggggatgttaccctgaattatccaggtaatcccaatgtagtcacaagggtcgttataagagaaaggcaggaaggcctgtgtcagagaagacgtgaggatgggaagagaggtcagattgatgcaaagagaccatgagccaaagaatgcaggctacctgtaagagctagaaaaggcaagaaaaaatggattttcccctaaagcttccagaaagaaacagcactgccaaaaccttgactgtcgattttgtttaacccagtgagatcgatttttggatttccgaatttcagcacactgagataataaatctatgttgtctcaagccaccaagtttaaggtaatttgttattgcagcaataagaaactagtaagagtaaggtgcaaaacctcaattagagaggaagaggaagtgctttttcaaaaaaattatttatttatttattttttactttgagatctattgcatggcatggtgaaaacagcaaataaataataacgtattatacagttcaaaatcactaagcaagtaaatttcaaatgttctcaccacaagaaaaggctttgagatgatggatatgttaattagcttgatttagttattccatatttcatccataaattataacatcactttgcactccataaatataaatgtttgtcaatttaaaattaaaaatgaaaataaactaatatgtgtactgagagctaatctctgcatgcaaccatgtaaagatagcaaattaccttctgtatgcatatgaataattaattgtgactgtacttcaggtggccatgtgtctgagaacctggaatacttccagaattaagagatgtgcacctatgatgcacgatgatgatggaagatgaaatatatcctgtaaggattccagatggacactcagtgctcttctaaattggacaattcgtatgtggggaaaagtagcttttcggcacatgtgagtccttggccagggaataatttcatgttaatctgttaatctactataccagcatcaataactatttgatttcactattttttagatcattttaataatttatgtgtataaatattttgtaatctatatagacagagtaatctaaaacattgtacaatattagaaggtacctgttaaattttgtggaaaacacagaaaaccacatacattagccacggttatctctgtgtttcacttaaaacttgctagtatgttttaattatatatattttgttttaaagtacaactatgaacaataataatagaaatggatgaatttattggatcataaataaacgcttctatttttaaaaatccatagaaaaattatccttggccaggcatagtagctcgtgcctgtcatcccagcattttaggaggcagaggcagaggcaggtgacttgcttgagcccaggacttcgagaccagcctagacaacatggtgaaaccctgtctctacaaaaaatataaaaattagccaggtgtggtggcccatgcctgtagtcccagctactcaggaggctaaggcaggaggattgtctgagcccgggaggcggcagttgcagtgagccatgatcgtgccactgcactccagcctgggtgacagataaagactgtctcaaaaaaaaaaaaaaaaaaaaagaagaagaaaaaagaaagaaaaattatccctgaatgtggcagagaattgggtaaaattaaaaggatcataagtatttcaataaaaacatgactaattttaaaatagaataaactgatggattataaagtgaccaacagtttgtgaatgaattttgaataaataagaaagcagctataaagaatgtatgtcaatttatcttaaaaatatagtttgctgtaaaacaataggaaattaaaacatagaaacattagaacattagaaaagaagtattattactatatccacaaaggagtatatgatatagtgaaaccccaggggttttgggaccatgaagttatacctgtatacatttcctcaaaaacatgggaaagtacttcataatttctataaataaagtcagattcatttttaatttatgtaatgctatgctagtttctaggatatcacaatgaatacaaaataaactctgcctccacagaacccaccttctcatagacaagtgagatagaaaacaatggccatgatagacaagacctttatgctacctcctggcgctgggcaatggagcagcccttgtatcacaggtcttcacaggagaccatagtacaaagaaaaggatggagaaaaaactgccaagcaaaggccttttaactaagtcttaaagacttaagagggaattatagaatgtatagaaaaagagggttctcaacatttccaaagtccctggagtgtattaggatttattttctccaggtagagaatatgaaatcttctgccctagaaatcataccttcccttctttgatcttggttccaataatctgtcgtctttgctgaatgatctcaatgagaagatcacactcctctgtcaatttggcttcttgacgtgatgcattgacctacaggataagtacaatggtaagtgttaatttggcctttgtttttcagttaagtgctatttttaatgtatactaggatgtttctagtaatctctgaaaagatattttaaatgttaactctttgtccgattacgcaaggattgcaaatataggacttacatggccacttcctaatttgcatccttggaaaacattattatccaatgacagcagtcttttctactaagccagactcagctgcagaatctttaacataacatgtacatagccattaccaattagttggaaaatgatgtgtcatgtgaaatatatttgcaattcctacttttatatttttaaaaagtatcaaatttgccctgttaaacataaaaaaagtaagttaaaaaaaatcaatattattcttttatggaggacagattactatcaatctcttttagacaaattttccgtaagcaatgtagcaagcctgtatcacatttgacatttctcttaaatacaaacatcaattttgtatctaatcactataaaacataaaaagcacaaaaagatggttcaatagtttattaatcttatgacataatttaaaattatactcctagtatacttctgaaagatcaaggttctacaacgaaagcataacattcatgtggaaaggtggatcattagagtggcttgtatttgaagtttttgtgacttgcattcaagggaggcttacaattagctcattcttggcaactaggcctgggaaatactctgcacatgctatttcctccatctcatggcaattctgaaatgcttattcacaaacagaaacccagaaaccacagctgtgagagatggagatagcaggcatgaggtttattattttaacacagccacaggagaagttgcaatgttacaaagaatgacaatggcattgattattctagcatatctcagggaggagacatggcccagtccctagcctttttgatttggaaggctttaattggagtaatttcattctctatgaatgagataaactggaagtagggtcatgagttcaagataaaaatccactgatggctgttcacagaaaccatgtcctgtttccagaggcccaggattccttgaattttattcctgatcattgttcagacataacatagagactactcaagacatcttattgagaagatgatagtcattggccatttgcagtaaaccatgagattatgtcctacatcagtttagcagacagagttatttgctaagtatttgtttaatgaacaaagagaaaaattaaaaatgcattgactgagaagtacaaatgtggaactcaggctaatatttcaaggaggataatcattaggcttcatttctcttattgttatttttatgtcatcatttctagctccccttgaggtttctcaaataaatttagctattgacatatttacttgaaacttacactcagtaaatttcttctgtttccttttgacctcaaactgaatttaataactgactacaactgagttatgaaaaggatgggaccatattgataacatgagcacattatgatggaggaagtaaaatttctagaaagtagcactgacgaagcttctttgctcgaccaaactttagtgttgaactttctcctgggcccttctgcgcactttcttgtaaaccagttttagcaagaaccctgctgagttggtttagccagaatcctccatctccatatctgatcactctcagtatctgattgggttcttcatccttcaccatgccccagaggatgtctgatcaacttggcctaccttcagcaagaatccttttaggtcagtttaaccagaatctcccttacccctgatgtttcctcttagtaattttccatccacttatcatcaccctgctccttggctgtaaatccccactggtccacgtgacattgggagttgagtcccattctatactgaggtctctttccccttattacaatagtcctgaataaaatgtttttacagctttaactactgtccagctctagtttttctttgacagaccccacacttgaaaagtatctactagaataaacccgaagagctaagttgtacttgagaatacgagttaaatctgatagaatgtaagctccatatgggcagggatcttcagctgttgtattaaataaggtatctattccaagcacctggtgccatgtctggcacaaaataggcattcaaaaaatatttgttgaataaataaatagggaaaatgaccttccaagaagagacagggcaaaaatgtaatggagcaagtagttatcactagtaatcactcaacatgcaggtaatggattggtttccaaggactgtgtagacacaaaattatgacctaaggattgttttatttgagggggagggaggaagggagttgattttttttgagacagggtcttgctcttgctctatcactcaggctggagtgcactggtgccataacggctcactgcatcctcgacctctcaggctcaagcaatcctcccccttcagtctcctgagtagctgggactacaggcatatgccatgactcccggctaaatttttttaaaatgtatttttttgtagagacgaggtcttgctatgttgcccaggctagtctcaaactcccgggctcaagtggtcctcctaccttggcctcttaaaactgctgggattacaagagtgtgccactgcacctggccaggaattgattttttaaaactgccttattggaatatatttcacatatcataaaatttgtccatttaaaatgtgcagttttgtgggttttcgtgtattcacagatgatttcatgtgcaatcgtcatcacaatctaagcctagaacattttcagtgcccagaaaagaaacccataatgtgtgcagtcactccacattttccctacctgccctagctccagcccgaggcaaccactagtctactttctgtctctttatggatttgcctgttctggacgtttcatataaatggaatcaaataatacataatcttttgtttggcttctttcacttagcataatgttttcaaggttcatctgtgtggtagcatttatcagtacttcattcctttctatgccaaataatatttcattgtatgaacaggccactttttatctcttctttaatagatgcacactgatgtttctagtttttgttcactataaataatattgatatgaacattcatgtacaagtttttgtgtgcccatatatattcatttttctttgatataggggtggaattgctgggtcacataactgtgtttaatgttttaaggaactgccaagctattgttcaaagtggctgcattattttatattcccatcagaaatacatgagggttccaatttctccacatccttgttaatgcttgttatcgtatgtctttttaattttattttatttttagtgggtgtgaagtggtatttcattgtggttttgacttacattttcctgatggctaatgatgttgaccatctttttcgtgaacttactggacatctgtgtatctatgttggagatatgactattcggatcttttgctccttttgtaattgggtcattgtcttttaattaatagaatgtattatttctttacatattcagaatacaagtcccttatcaaatatgtgatttgcaaatattgcctcctgttttgtgggttatctttgcattttctttatgataccctttaaagcacaaaacatttttaaattttaatgaagttaatttatctacttttctattgttacttgtgcttttgttgtcgtacctaagaaaccattgcctatcccaaggtcatggagacttactgttctgttttcctctataagttttatattttatatttaggtctatgagccattttgaggtcagttttgtgtatggtgtgagggtaggcttctaactttatatggatagccagttgtctcagcacaattttttgaaagactattctttctttcactgaagtgtctgagaacctttgtcaaaaatcaattgaccacattgtgaggtcctcaagttttaatgttgtcactaacatattccacacttcaagctcttctggctttgactaagtccagtgagaacccactgctaattctagagtacgggctgtgaaatgaaatgtggtgtgtaatatacccacatggtgacattaggaaaatcttaggctatctccatttatgagttttcctattttgtaaaatgagctgaataatatctgctctcttagccgtgtggaattattgtggtgaatacatgaaataatatatgaagaaacacctaaacttatgaagccattgacaaatctgaggtactgttgtctgcattgagaagggattttgtaaacagattatgatttagtttagggtccattcactctcacaatcattgggagttgagttactgcatggtagaaaaagtatcccagttgccattgtaatatggggctcaatttaatccaaattttgactatttgatttacagaatggatatgtttgctttaccaaaaaagtgggctgaaatcttccttgttgaggcaaatgtgttttgagaaaactggtatcacaatcaccatcaccccaatatgtaaattcctagaaatttgggaacaggatctattcattttaggccaagtatttttcctagatctttcagagaatacagatttagctttccttttgaaaccagggaagttgaatcttgttttctactttgatgaatttccaaattcttgtaactctagtattcttatattccaaaagatacaataaaacaagttaaatactattctatatttcagaattttttctactacaaagaagttttccacagttttgctgtttcatgtgtcacttaaacaaagaattaacgatttgattggactttctcattaatttctattagttcaaatatggcagggtttattggttacttgcagttatgttctggtgtttctagttcccaggtttggtttggaagctagcagctcctggttatgatttttgctttcatttctgattcacatcttttgattcagaaatcattgtggctgatggaagtgctctgaggagggccaatctaaggatgcagaaaacaagttcaaactcttctttccacttttgtgccatcagtctcctccttggcccctaaactaacggcaagagtgagatgaagataattaggaatgatgtccagtggtgggtaattactgtctcctgcctttggaccacactggaaatggggcacttgacttctcaggatgaaatacagcttaaaattaggccttcctggccgggcgcggtggctcacgcctgtaatcccagcactttgggaggccgaggcaggcgggtcacgaggtcaggagattgaaaccatcctggccaacatgatgaaaccctgtctctactaaaaatacagaaattagctgggtgtggtggcgcatgcctataatcccagctaatcgggaggcagaggcaggagaatcgcttgaacccaggagtcggaggttacagtgagccgagatctcaggctaggctcctcaatactatggttttttctcacctcaagtacactcatgagcaaatatcacattagcccaccagtatgagaaactcagtcactttcacctcatctcatttttgacctcacccatctgctcagcacataccttctctacatctagagtcagttttctttcgcgtcttgaaatgcatcttctccccatcagtcttgcctgtagggagttgctgacccactttctcctattcctagggtaatactgctgcttctctctgccaatgactttctgatcctttacagtctgatgaaagagatattacaaaattgaataatgatgtgaatgtagaagcacaacaatcatatctggcctgcctagtcctgagatggaattcagcattgagggtcactcggcttcattaatgctcatatctgccaccaataatcagttgcagtcccatgtaagttgctactgggtgcacggtttaccttccctttctagaaatgcagttacgcgtaatcattccccagattagttaatgatgacataaatggattagctattttctcgagggcacttggttagcaacgcccaaagtctccctgctaagttttatggtgtaatagtgttacagtgttttgaggaatgggtggggtaaagaggacaaatattttttccttgtcatatatgtataaacattaaagggatttagttacatacatatactagaaattggactaggtgtctgtgaaatgttctttagcagtctgtaagtggtttttaagtattatttctaaaacctggctcttttaatttgacttgtattcaactgcaaaatgagatgttcagtgcagagtataaacatcattagatttcagacatgtgtgggcttaaaatctttagaaatatttggaactcttaggatggagcatgagtgaaggaaaaaaaatatctggccagttttcacaggtgaaattgatctagcatgcattttagaaactctcattttctcactttgcagtgctttattgaaataagttagccatccatagactttcagaatacagccttataattcctcttgtgaaaatgacacactgacttgatatatcacttcttattcgtacacagacggaaacactgaagtaagcttgggacaggataaccccaacgtgttggagacaggatattctatttctgggtgttgagaagagggttgctgcactgcacaaatccggaggctactattcactttgaattccgcaagaatggtagaccccttgagttgtgcctctctcaccccggcccaccattactgcactcttgaaattgcaccatcaaactgtgaaccctttagtttaagattctgaaccttgccatctttgaaaccattaccaaggagttgggagtttaaaagacaaatgtctactttacaagtttgcctagattcggcctcatggcaaaaacaaaagctgtttcatgccacggtgaataaatgtgaccttccattccaaggtcacaaattaaggtgatcttgagaaaggctgaaacatttttatacatgatgctaggttgatgttcttgttattgtttagactcaaaaggacttttctctataactaagaatatgtaattttgagtctgcatccaaattcgaaggggttagtggtactacataatgtggcataaccatcccatctcactccaaaggaaaaacattggaggagttaattccaatttgcccaaggctgaagtaactgaaacaaaacagagctttatataagctgatatttggcctgtggatgagggtacagggagaaaactgtatgcaagtgggctctacaccccgctgtgtaccactgaccaggtgcaaaaagaaatatgatgatatgagggtgctttgggttttattgccaaagacagctgtgatgaacattccagactctggggcaaaagttagacagagctgccagaggaacaatgaaagggattctaatacttcagtctgtatataaaactgagccaaggagaattgaggaacagcagacaatattaccgtaattcatctgatatgtttatatgtaatcttcactctgaaactctttcacaccaaagtcaaatacttgtggacctggctcaagtgaatgagagagagagagaatggcctggctcctgaggtctctgtctttggaggacaaaccagagtacgggacaatatttttaatgtttaatgtgttaatttaatatttaacatttttgatcaaatctttttaaactccaagaaaggcttttcagaaaaattaaaaatggaatcctttcataaagtgcttttggtgggaagtaatagcagtgatatagtgatacaactagaagctacatgtaatcctgctttagcatagtgacgtagtggaaaattatttggaccagaggagatcaattctacatattgattatccagatgggaatttgctatgggactaaaaaaatagctccgaggaacctcatgataaatcctcttttcttgaggtttctaagattatgaagcttgagtgctggacaaggaagcaagacactatcaaaaatggcaacacactgtggtgagtagagcaattaaattctttcttatgaatgaaatacaactgtaataaggcaataaaactgcctagcaaaaaatgccattgctaatgcctaaaactttgaaacttcacataaaggagttttacttccaatagtagcatacagaacatggccattcacgatgttgttgatgtcgctgttagtttttcagtaaagcaaaatcttcaaacaggtaaaataatttagagggagcaagggctaatggaggcagtggtttggggttcagggacttgaggaagtcttcccgggattgaaacaccaggtttttattgcttactagttgtatgttattgggcatttacttcaactatctacatctcaagttccctacctgcataatgaggaaaataacatttgttacctggcagaccaggtgcgatgctgctaaacatcctacaacacattagacagcccccacaacagtgaaaggtccatccccaaatcccactagtgtcaagattgagaacccctgggttagactgtggtgagaactaaatgagtgaaaacatgaaaagcccttgacaaatgcttggcatgtaataattactacataaatgtgaacgatcactattgctaacaaactctttttatctggaatgtccatagataattaaaactagaggttctaggaccagtcagcctgtgctggttacctgaggactttctagcatgaatcaaaactttgatgcatctacatcatcaaaataatagctttggaagctataacatgaggcttaactccagaatttttgaagctacttttaaatcctaactgggttccttgaaggctgcctcctgatgcaattttggatgggggaagaagaagggtagagaacattcttccgtggtacagagcaggagttgggggactttttttttttgtaaaggcctagatagtaattattttagcattgtgggccagacggtctctgctgcagcttctcaactctgctattgtagtgtgaaagcagccatagacaatacggatgcaaatggacgtggctgtgttcaaataaaactttacttacaaaaacagtcagatttagcatgagcgtcacagtttgctgacctctggcataaaggaaaaatcatggactttatattcagaggactgcaggtatgaaaaatatttgaatttctgtgagaatgtttcctcatttgcatacttttgatgaaaatatctgtaaacaatctggtacatagtagatgctcaataaatattagttttcttcttttaaggcatgaatagctacaagtactgaattaatggaatttcaatttgaaaatgacaacatacttgcggtatggttttcactttccccatgatgtcctgctgacttctgtcacaattataataaatgttactccttctgtaatgtttttcctaggctacactcaactgacttcaatcttatattcttggcatcaatatcacagccttttctttttgtgtttaatggtaactttgttagaagcagttccaaaatgaagaagcagaatggaaggggttgctcataattcattgaaaaacaataaactcctcccttcctttctcttattaattacacactttataaaacaaatgcttcacacccttccgtttgggctgggcacactgaatgaaaagaaatctacttaacctgccatgggtgtttgtctctatcacgtctttttcataaagtttctgaaaagtagcgatttctattaaataattttcaacaaatgtgtttggcatttgatgttgtggtcagagggtaaacaataacttttagcagatgaccattaatggagtgccaggaaagatggaggtgacgtgtttaagggaagggaagttatttctaatggaaagaggaaacctctactctatgactttaccttaatcactttcaatcttacatgttatttctcattaagtgacattccttttagttgttgtgccatgattcctgaaaagtgatgtactggaaaaatactgagttggacccctttttgggtttcagttactcaggtatagaagccatctgcttctgcaaagttctggaaaatgaacattgggtttctgctctttggtattccgtacagtgagtgaaatacacgtgattacgtcactgatagaacttaactgggaggtacaactggaaaatgttaagctttgttctgccttcatgacgcacccacaagtgatatctatgaaatatcttgccctgttgttgtcattctagaatatcaggagaagtgagtagattgatttttaaatatctttgatgtccagtgattcacatgtacgtttattcaaacacaatgaaagagacttgagtttagagaaattgaacatgtgagctatagccatgactagaaaaagagacttgtgctatcatttcattttagacatggttggcagttgtatcctccccaagaaggatatgagacaagaatggatggtcaaattgttgccagaaaacaccagtactgggtaggaagtgaaacagggacaactacgaagccagtaaagtgtgacttaccaagaccaccttgggcaactggagattaaccccattgggcaactctgggaaacagtacagaacattccagctaatagggaagaagcagagtatttatgtaacatctcccatcaggagctggttgaaagctgttgggggaaggtaggcattaacttccctttggaattagttggtcctgggaggggcagaaaaagttcccaggccagggagataggacctgtgagtgcaatatgggtatggccttgacagctgtaggcaggagctcttacactagaggagactacaatataaccattttgagctctcatggaggacagagagagctggcatcacagtcatccaatttttcagttccaatgacttgtgactaactgtggggctaaacagaatttgcatcggacagtgctttctgtactggccttggtcattcctgacttcagggtcacaatctacctacaagcactcatttgcaactgactgtaagtgggtctaagtttgagcaatggtaggcaaagttccctgaaaaagaaaacacgtgacatctagcgtgtcagaccaaaatgtatatttcctcatctagtgactcctaacttccatcatttcaactcattgtgaaattattattgtctttctggaacaatggtttgagaacttgaagcctctgcagtaaacttgacttttttaaagcttgagttaaggattatttggagaagtgtccctctctctccctaccccctttttttcctcccccctccgcccccatctctccctctttatacattatcattaaggtcaactatatttctataaacaaacctgacagatgttaccatctaaccttcctacctgggaaacagaatggtctgttgaggtttgtcaggatcggggtcagggttgtgggaagggagagggcagcctgccaggtaatggaaacactgcttgctttaattttattgccaagaacaaagccttcttattgtttaatagaacccttaaaggcaggcctcattggcatagttctaattttttcgagaccacaaacaagaggaattctttagggccacttcgtgaaaagcagaagaaaaaaatagtttattctgcaaaaattaaagcaatcctttgtttcagtagccagtgtctgatttcaggttggcatctgtatgtgtcctctctacaggggcatttgttggcattgtctgcatgggcacccactctttcattcagattaattggaggttatgcctgacatatgaaggaactggacagaaaccatctttctctggcaaatcatccctttggcagcaatactttcagataacatgctaaaagaagaaatgtttcgcaccaaaaacaaagaagcaaacactctcctcttgcaaaacctatttataaaactgggaaccacacacatcttcattcagtgcttattttgattctaccagcaaactaaaccttctatgcagtccttgcttctcagcagcaagttttacttctctctccatttaaagtataggtgaccaaagtttccggtttccagagatctttgcaacagtgttagtagctaaggaatgaaagtgagaggagatgaggtcattcttgttattccatgaatgaggaagatgctatcaatgtacagggatcatctatgaagcaaatcttagggatttgttgagtgcccacaatgtgcaaagcaccatgctaggacctgtggtagaaacagaacttggcctgctagaaagaatgacttcactagagaacaagcagcgaacatgccaagtgcacacataattaactgctaaaccatgggctacagaagttctagagctgtgtggtccaatatggccaccactagccacttgtggttttgagcacttgaaatatggttagtctgaattgagatgtgctgtgaatatgaaatgcatacattaatcatttttacattgattacatgttgacatgataacattttaaatatatcggggtcaaataaaatgtattagtacaattaattttacctgattatttttacttaaaaaatgtgattacttgaaaatttttcaattacatatgtggctcacattacacagtactttgattggatgatgtgactctggagagtttgagaaatgaggcaattactgtgtgagtagctgaggaaggtttcatgccaaatatgaaggagagactggtctttggagatcagagtaggcaagacagagttaggaaacccaggggtgaggaagatgagaaaaggcaccagggaagagaggcaaaagaacatttttgcaagacagaggaaattaaaattctgtttcaacaacatgcagggtacagtgggcatgcatcttgaattggttatctgggaatggggagacagaaataccgaagccagttatatcttactgccccttgtgaaaagccttttgggggccatttgcagagagctagccatgactgagctccatagagtctggctaaaacaaaacagcaaattgaggagtttaacttgggagtggggagttcttccttgacccccacctttttctaattgactccctttgtatcctggtcttagtgggccttcagcattgatctttaaagctatccatgcttacttgctttcctggagttttcttctgaaatggtagtggggctggtaaaagttacaatggcagtagaagggcaggcaggaaggacactggagagctgtacaataggggctttgacaaaaggacagtgaagagcaaagctaatctgatctggaagagaaaaggaaagatcacagcatttagatgtcttttggttgctaattttgaagttgtggtgagtttgtgagtgtgtgtgtgtgtttgggaatcatgagagactgatattgaaaatgttttcctgttaagtcattttcagacctaggttgattagccatcttacatgtgtggaattattatttataagtgttttcccaagcctgattcaaagtgactatctaactatttttttcttttgcaaaccagaaaagatagagaaggtatcctagagaataaaaggaaaggtacaggtttataataagggggaaggaaagacccacctcgatcgatctctattcagggctcagcaacactcctgatggacagctctctcatttttgacttccctttgtcaactccatcctcttagccctacctgggtggcagagccctcaggctgggagggagctccttgtgtgcactagcattactgatcctccagggatttgtggctactgaggtttgctgtcataaaaacacagtgctgtgtacagtcttctcaagaagggtcctttctgcccttcaaggtgtgagcttatcggacatgctgatctatgcaaatgagctagtgctacaaggaggacagaaggatgatgtagttggcctctagaggtgttccattcactcatcaatagtcaagtgctgcatgctaaacgcagcatactaggaagactgtcctatttacccaggagtccaaccaactaggagaaggaatagacacagacttacagaccatcaagatttttgttcaagaactgcatctatgtcaacaattcactatgtagtttcccttaagcttttaagttcaaattatgatctcattattctattcatacatctaataaattttatgaaaccaagaataatcactctcgggagtccttgaatcaatgtttgattaactcaagttgaatagactcaactccattaaacaatcaattctgtctatacattagctgattaagttcctacacacatatttttaaattgcggtaaaatttacatgcaaggaaatgcatagatcttaagggacagtttaatggattttgataaccgacagctcaatcaagacataaaacatttctatcaccctagaaagtaccctcgagccgctcttcaggtcaatcctcacccctatgaggaatcactgttcagattactcctgtaacactttaaactgcatttatcaatttaacacatttgatttactttataagcacttcaaatgctaacaggataaaattaaaatcctaacacgttataccttcccaagtccttaagtagctcttataaatctaataaactaaacttaaaaaatatgctgaaacccaggccgggcgtggtggctcacgcctgtaatcccagcactttgggaggccaaggtgggcagatcacgaggtcaggagatcgagaccatcctggccaacttggcgaaatcccggtctctactaaaaatacaaaaactagctgggcatggtggtgcacacttgtaatcccagctacttgggaggctgagacaggagaattgcttgaacccaggaggcagaggttgcagtgagccgagatcacgccaccgcactccagcctggcaacagagcaagactctgtctcaaaaaaaaaaaaaaaaaaaaaaaagaaaatgctgaaacctaaggttttttgaacattgcaatattgctttgaaacctaaactatcttacagatccaacttaaaataacagttctaaaagaaattacatgttaggctgggcgtggtcgctcatgcctgtaatcccagcactttgggaggccaaggcgggcagatcacttgaggtcaggagttcgtgaccaggctggccaacatggtgaaaccccatctctactaaagatacaaaaattagctgggcatggtggtgggtgcctgtgatcccagccactcaggaggctgagacaggagaatcacttgaaccccaggaggtagaggttgcagtgagccgagatgacaccagtgcactccagcctgggtgacagagcaagactccatctcaaaaaaaaaaaaaaaaattacgtgtttcaaattagcatttcaaagcaaatctgtcaaatttctgtaatatgtcatattatcttaaatgctatgaactattaacatacaaacaaatatttcagtcccaagttgtaatatatatatatttttaagttcagggtctctgtctctgtcactcaggctggagtccagtggtacaatcatagatcactgtaatctccaacttcttctgggttctagtgatcctcctgcttcagactcctgagtagctaggactacaggcaagaacctccactcacagttggttaattaattaattatttagtagagacagggtcttgctatgttgcccaggttggttctaaactcttggcctcaaacaatcctcccaccttggcctcccaaagtgctgagattacaggtgtgagtcactgcacccagtcataacccaaaatattgattttatgctacaggttgagtatcccttatcctaaatgcttagaaccagaagtgttttggattttggaatatttgcacatacataatgagatatcttggggataggacccaagtctgaccactaaattcacttacattccacatacaccttatacacataagcttgaaggtaattttatgcaatattttcaataattttgtgcatgaaacaaagtttgtgttaagtacttgtgtgtggaattttcctcttctcgcgtcatgtcagtgctgaaaaagttttggattttagagcatttcggattttggattttcaaattagggtggctcagccagtattatttagttcttcatctttatacatgaatctcaaacttcctgggaaggaggaaaaaaaggaatttacttatttactaaaggaaacaaatttatcatctcaaagaagttgaggttagagggtcaatggttaataataaaagatttcagaacgttcataagaactgaagactcactgattgtactggcactgcagatgtacacttgctgagcctttgttatggtgggtttaacagggtttccaattacctatctgataagatggttcttgtaatgagaattcccctgggaatctaactttctaatcacctggtttgggttcagtaacaactccagttacttattacttggttaaattcaacctatttctttactggctgattcttgttatatctggcttcaggccacgtatctgtggttatttgaatgatgtttatgtcaaaagactgttgggataattaaatcaggaagtgacagtaagagctggtcatggtcataactgcttgtagtgcatatctacataagtcctatcactttttctttctttacactacagtctatgtgttgctgtgaaactggaacagatctatgcaataatgctccccttccaacacctgcaaagatggacaaggcaccaccttcccaatcctatggaaattgacagaaggcttccttgaatgaacttatgacatctcaataccaagcttgccttgtcagagaattagaccactatatagttttcacgactttacatatatgaacttgatgttatatctagggaaaatacttttaaaagcatagtaaaagctctatcataaattcctaggccaagaagttacctcacttggttgtaaaaatctttgtgttgctcctcactgagagccttgtacattccatggtagcctcgggcattttaaatagctgaatttaaaatttcatatttctatttcaaacaaaaataaccagtactacaattgtcttcttgttaacggacattttatatgcatgactcaattattttgctgtggaatttcaaaattagaacaaagctcttcattttttcctacaacatttaatttagcaaattaaaaatagaagtcaaccgaatcaggtaaaaaatgatatgtctggcttctttcataatctgtaattattttatacacagagataatttcaacttgattgtcattggaagacaattttatgttcatttattgagaaaaataatttaaactagatattagacccagaagtaaaaggttggttcagtaacaaaatggtggattgattgttaggattattcttgtttctgaatgtcatgaatgggagcaataagtgaaccaaagcttttacttgagagttaccttctcacctgcaatcattccattcccctctgactctttcacctgaaaccatccagctaagaccatctcatataaaagttgagttagaaataacaatggccattttattttattttactttatttgagacagagtctggctctattgcccagtctggagtgcaatggcgtgatctcagctcactgcaacctctgcctcccaggttcaagcaattctcctgcctcagcctctcgagcagctgggattacaggcgcctgccaccatacccagctaatttttgtattttaaatagagatggggttttaccatgttggccgggctggtctcgaactcctgacctcaggtgatccacccactttggcctcccaaagtgctgggattacaggcgtgagccactgtgcctggccaacaatggctattttaaaaaatgtatcactacctgttcctattattctttatatcatgccagaaacatctctgctgctctagtcaatcacgcaagtaaatatttccaggtaaagaaggttgtgtgtggaatactgtaatggagacaggataaggaattcttgtattgtgtggagggagggagcacaataagatatatcagaaaaaagcacactttctctctaactttctaatgctcagcctttgggcctccaattaaggcctattgcttcacatttaagtattaaccttggaaatctgcactaccaaattcaaacattagagggtttgtcttcagaggcacgtacaagtgttcatactccaatctgagccactaggtaggattctgtatatgatgcaataggtcataccacccaaactagaaagatttgcagacgatgaaaggtttggataatgttttatataaagtttcaaaactgaaacttgggaatgtcattctaaaagtaataccagcttactaagccttatattcatttattcataagattaatctcattccaaaatactcaaagatttttgctgatatcttctcattactccttatgaatatgcccaagaaagaaacaggatccaatgcctgttatgaatcaaatttttctaagtcaagggcactgaatccaaagggagacattcaagtatgtgttagatactttaataattaaatttaacctctaccaagaaaaactacatttgcttcatgagttgtcaattttagtaaacttggtagagtaaactgtttcaactgtcttactattgcatatgaatagacattattcaaatgcaatagtaaaaacaaatcttctccagagatgataaatttctgtgcagaccaacagttcttttctcctttgtcatgggaatcctaagacgtgaacttgggaaatcaaccattattatagtggctcgtcataatccagtttctgaaagccaccatatttgcactatcacattatcataattctagagcctattacatggagagccagagctgactgtgggttgtatgatgtggtttaatgaggcccagaatctgactctaattataccttgaaagcattctcacagggggtcagatcgggtgggaatctgaccctcatctgcaagtgaaaatggattataactttggacattcatgtcggcccccagcaggatatacttcatccaagatcagacacacgttcacaagacacaaatagctcgtttggtgtttgcatgctggtcttcatccaatgactccggatgaagccattgccaagttttctacggagagagaatgctttggcattacaaaactgcacaacaaaattaaacaaatggttcatctttctttttaacccagtgatttttcattatttcaaagtttacaaatgaatgcttttagggcttggtgaattactggaaaagtcttctacagactcccatctgttttgccaagtgattttctacaatttcttacaaggtacatatcacccaagtaacacctcactctcatccttttcaatttacaaaactcatcatctgagcagaaatctaattaaacagccttaattcctccacaagaaccttgtcactttacatgacaactagcactggagaaactcagagaaagccgtatgagagcaaactttccattaaaataaaacaacaacaaagatagattaaaaacttagtgagaaaaataatggcaaaaagaattttaagaagtgattacaaacaaggcaagataaaccaaaggggccaatgctggaactttgaagtgatgttggattagaaaatgcccttctaggatgaccttgagcaagaatggtaaggactgctgagcctttatcctcttgaaaccattatggcaattggccaccctttcccagttgttcttggccatcatctttagagtcactggcacctatcatttccaaaacgaacatctattaagtgtcaaggtgttgtatttgctgtaaaagaacttgattattggaatgtgcagaaaatttggtacatatcagtgattccaagtgtttgcttagctaataaactgtgtcttctgatttttcaaagaaaatggaaagagaaatgtgatgaagagatacagtccttatctgacctagaaaagttaagttctacaggtgacccaaattttgatcatttctcataagcttgtctttcactacatatataattaactccaaacttgtctagtgtaactacaaactcatccattctaccttatttctctcctgaagaaaacaaaatagagtggttgaaaacccattagtttttacaatcctagacaaacatttcttaggagtctacctgaagttgctcttttttttttttttttttttttttgagacggagtctcgctctgtcccccaggctggagtgcagcagtgtgatctcagctcactgcaagctctgcctcccgggttcacgccattctcctgcctcagcctcccgagtagctgggactacaggcgcccgccaccatgcccggctaattttttgtatttttagtagagacagggtttcaccgtgttagccaggatggtctcgatctcctgacctcgtgatccacccacctgggcctcccaaagtgctgggattacaggcgtgagccaccgcacctggcctgaagttgctctttcaatgtctctgcctcctgagtcccaaactgtcttggccttcatactctgctcttgtgtgtgtgtgtgtgtgtgtgtgtgtgtgtgtgtgtgtgtgtgtgtgtgcgcgcgcgcacgcgtgtgttttaagagacagggtctcactctgtcacccaggctggagagcagttgcactccatgggtcactgtagcctcgacctcccaggctcaagcaatcctccagtcttggcctcctttgttactgggattacaggcgcacaccaccacgcctgtctagtttttttattttttgtagagacgaggtctcactgtattgcccaggctgttattgaatccttgggctcaagtaatcctcctgccttggccgcccaaagtatgctgggattacaggcatgagccacagcatgccattctctgttatccaccgttttaaaaatgtttggcacttacaatcaaaaagccattcatttgcttaccctcatttaaaaaacaagttatgaaaacaatgtggcaggggtggggagagttgggtggctgaaggggaaccttcaaactgttttccattctgaagaaaagcagaggtaaatccctgggaagagatgtggacttataaggatgtggcatttcctcatgggtcgtgggaaggaattcattgatttaatttacaacaattaggaggtgcctctgtgctgtgagttttttttagctccagctggcatgggaattattttcccggggaatgctcatacccaaatacaaggacaccttcaggaagaggaaaaggaagaagtaccatctaggaaccaaggatgtggaccaggaaattcttttccactgcactgatttaaaagaatagcatgctggtgcctaacaaactccatggcctttttggagtttcctagtgctgtgaaggtttcccttggacatgagattgttttgcatgacaatatccatattattttctcaataaccaaaaatgtcatttcctgaaaagagttggaaatgccagttgtcactgtgaaactcacacaggtctatgtgttccttgaaccctcactaaaccttcaaaaccaaagttcaaattcagatgcaacacgaaagcctttccagctctcaactctcccaaactagttcctacagatccttccttcttccatgctttccatttctccagaatgaactacttgctttgtgtacatacattcctcgtctttctatccccatgcctttatttgcctggcaagcagtgctgcttccataaactcaaatgttacctacccttgaaggcaggctcagatcttgcgctgcttccccagtccccagctagaaataatttcttgtttctctgaaagtttgaagtagataatccacaccttcttcatggtaattatggctttctactttattttgtgttataagtgctcttctgtcttagtgaagatagtaaacttcctgtgggcagggtcctttggcacctaacacagtgcaacacacacacagtgggtactccaaccgcactaccaaaatgaacaaactagcaagacactgtaacaaattaaagtaactgtccacaggcaaaaatgtacatcccctcccagaaatatttgtttagcaaacactgctcctagaccaacagtctctagaacagaaagtcatgttaagcaaaattatccaaaacatggaaaaaagagaaagagaagactgtgagcccttccaaagtcccacgagagcatattccatgaagtcagcctaagtcagggtcatctgactctccagactgggatgtaacagagtctgactttctatttactagtggttagggcttagactctgcgaagttagatgttaacttagagaaacccagtaatatgcaacttattttgtccaaatgtttcaggtttattgccctgtaggtcactaaccagttttgtatccaaattagctatgctagtctggcattcttttccccctactacccccttccccacatttatatgtatccgtttctggcatcctccttggaagcagctttatcatcttgctggttccttcattaagaagttaaaaaaatctttgatgtggactaattcattcattataggagaattgggtgttcaacttttgaaaattatactttcagaatactaataattaggaataaaaacaaacgtaaaaataagtactgtaagtatcattatttttgtactcataattttctttaatttttatctagaataaatttcccaaataccaaatttactcacccataaacatgtgcttccattcccaaggatttatacaaaaacaacagagaaaagaatgaatattctttattccttgtaaatgcaagtccactacaatcaattcagtaatagctttatttgaaaagcctgtattgcaactaaaatcatatctgatctattaaaataaaactaaaatctccctgtaaatttcttcaatttatctatcatttgaaattactgaacatcttagaatgtaattttacatcatgttaggatgaatagcgtcttgtaaattcaagccataataatattgcattagaagcaatgcatttgttctgaaatcacaacaggtcataatggaaaccagacattaatgctttaaggagtaactagctgaaattgaatgacataatcacccaatccataaagcatttataagatttaccataaagctcaggtaattttttttttaactgaagagaaataattctttcttactatcctaaacatcaaatgccatcacatcataaaaataaaatatggcacacagattattccattttgttcatccatttattcatataatacatattaactttaccctataataatgaaaacattatgcttgttcactattatttccaatgttgtttaatcaacaaggctcaacatgttccctggcaagaggcttgccaaaagagaatccagtctaagcagagggttcaaaaggtctggattctgcaacacactgctgccttcacactctcaacttcatctcaacatgatgaaacactgattctaccctgacaatcatgtagcttttaaagcaagagggtctactaagtgaaccaataagctcactggacaatcctaatctgctctctcacctatgttttactctgattcctccctttctttccttttgtatgcctttccctcttccacctatcataacctccatcagcacctcaaatgatgaacagctggagtagatggcttaggtaggagatgagaacatccctaatttctgtctccctggatattatccttggaaaacacaacaaatttggagttggaaaaagttgctaactcatgtgtttctcttagtaaccagttttacatttctgatcacaaggggagcacttgtaagtaaaagcacagactttacaaacacaaagtattttaagccttccaccaaagcaccagtatttgcatagtagacatgcttttacactgataggatctttctgaaagcaatctttgctaatttctgctatgctgaggaatgtatcactgacaaacatcattgtgttgcataaataagctgacacctcaatacttagggtactgaaaaataatagttgtgaaatctataagaactggctcaagtcctgactcttccacaaagcttcagaaaaattgtattcgcatttttttctcttttaatccccccttctcaaaccatactccatctaatctaagataccagcaactgtctcatctatattttgtgtgccagtaggaacaaacaaatgttgcccattaaactgtctcaccattcatttaagttgcagctcaatttcagcaatattagtcttcaaaaaaatgctaatcttagaatccataaatgcaatattctactagctgagcacctgattggctactctactgttctttaaatatgttgttatatgtgtgtacactgttctctaacatattgtaatctttattattatttgctacattgtgcatctactgacagttataggcacataggaggctataaacttataattactgcgtagacgatcaaagggacttgaaggaattcttattgcaaaaatggagttactgtcaaaatttttaaatgcctgctcaaaataatttgcttctccaactttagatattttaggggagctgaacttgcaggcattcaaatagtgttcaaaatttgccatttggagagtcatcatgcaaattcatctaaaacaaattccctgagctcctactgtgtgaaaatcattgcatcagagtctgtgagatacaaagacgaattagatttgattcccatcctctaagacctcacattctggttggaaaaatggaactggtacatgaaagaatgataaagccatgagaagattattactattcttgcattgctataaagaaatacctgatactgggtaatttacaaagaaaaggggtttaattggttcacgggtgctgcagggctacacaggaagcatggcaccaggcatgtgctcggcttctgatgaggcctcaggaagcttttacacatggtagaaggcaaagccagaactggcacgtcacatggcgaaattaggagcaagagaaagagtgtgtatgggaggggggcgggcggtgggggaggagtgtcatacacttttaaacaaccagatcttgtgagaactcactcattatcatggaatcagcaccaagccatgagggatctgcccccatgacccaaacacctcccaccaagccccacctccagcattggggattacaattcgacatgagattggggcggggacatctctcctttctctgaatcacatacacggtatcataaaatgttacgtgattcagagaaaggagcgatgactctggtccagggaaccagagaaacgttcacaactgaagtgccccttgacttaggacttggaggatacacaagaagcattctgacaaatagacatgggttagaggaatgggcctaccagtcagagggaactgcttggttaagggccagaaggcttaaaagtgtaatgaatgataattgtttagtttcagttcatggggtggggtggtaaaaaagacagtttgggagaagatggaagaggaatttgaaaatcacataaaggaagtggcatctattttttccttattcagtgtagtcattgcaggttctgctgttgttgcaattgtggtttatttcatggaaacatatctgacaactaagatgcattaatatacacctgcagtgcattaaactgtgtccgcaaaaaggtatgttcaagtcctaacccttggtacctgtaaatgggaccttatttgaaaacagaatctttgttttttcttttttgagacaaggtctcactctgtcgcctaggctggagtgcagtggtgcaatctcagctcactgcagcctcgatttcccaggcttgggtgatcctcccacctcagcctcccaagtaactgggaccacaggtgtgtgctcccacgcctggctaattttttgtattttttaatagagatgggtttttgccatgttgcccaggctggtctcctgagctcaagcgatcctcctgccttagcctcccaaagtgctgggattacagggtgtgagccaccatgcctggcctgaaaatagagtcttcgcagatgtaatcaagttaaagtgaggtaaggctggagtagggtgggctctttataacaataaggaaatttggacacatattcagagacacaccaggagaatgtgataacggaggaagggtttagagcgctgtagctgaaagccaaggaactccaagaattgcctgcaactaccagaaaatgggaagaggcaaggaaggatcctcccctagaacctttgtagggagcatggccctgccaaaatcttgatttcagacttctagtctccaaaactgagagaataaattagtcttgtttcatactttcccagtttgtggtaatttgttatggtagccatagtacactaatacaataccttttttttgagacggagtctccctctgttgcccagactggagtgcagtggtgcgatctcagctcactgcaagctccgcctcccgggttcatgccattctcctgcctccgcctctggagtagctgggactacaggtgcatgccaccacgcccagctaattttttgtatttttagtagagacggggtttcactgtgttagccaggatggtctcgatctcctgacctcgtgatctgcctgcctcggcctcccaaagtgctggggttacaggcgtgagccaccacgcccggcctacaataccttttttgactgttctttgtaagggcaattaaaatctccaacattaggactgctatgtaatgctagatcaggaagagctataatgggaatgggaagcagccctggatgggaaagactctctgaagttctaattccttttaatttcctccatcttttattttggcttttgcaaaatatttaattttaagaaagattcttgttttaaaattataaagcatgaggatatcaaaaccttgatctggcagttttcatatgaaacataccatacagaaatacagagatactcacttcaacatgttgacaggtttggatgagtttagccaaaagggtctccagttctgtgttcctcttaataaggttggtgaggttactctctaagttttgctgttcaaaaaaaaaaaaaaaagaggaaaaatattattctgcatacttttatacttcagatacacaaaattactcattctcaggaaaaactgatacatttttcagaaaccttagtgaaatcgacataatttcaagtatttatagatttaaactggattttcaaaagttgcatttaaaagaaccttttagacacgctcagactttattctttttgttcctgcttcttgcactaactcagggatacttaacagaataattagttataggttatctctaggtcacgacctaggaagaaaggaggtaattggatttctatccctttacttgaatcagagctggcaataacataaggaatatattcccacatcaaatcaactaccattggatttttcagatttatccttttatgggcaggctgaggctaatcccttggaggaaggtttgaattgtttagctcttgctgacaataaggtcatttatagacatttatgataagtcctcatcacacacacatttggtcagttgtagtggagttgactctgtatccactgggttccacatacctggattcaaccaactgcagatcaaaaatatttggaaaaaaatggatgactgcatctgtactgaacatgtacagacttttttctcctcattattccctaaaccatagaatataactactatttacatagtatttacattgtaataagtaatataagttatctagagagaatttaaggtatgcaggaggatgtgattaggttatatgcaaataacaggccattttatatcagggacttgagcatccatgattttagtatctatgagagaccctgaaattaatcctttatggataccaacaaacaattgtacattttattgttcatgcttctattctttgtccatcaatgccagatcaaatttctttgaacactgtatttaccactcattatcctgcataagactctagaattattccctattcctttagagcatcaaacttaaagttctctggaatgactatttaatcctattttcaaacacaatagctctctgttctgggtaagactcactaagatttctctgttccttctcattcacatgctcttgattgccaggggtgtccaatcttttggcttccctgggccatgctggaagaagaactgtcttgggccacacataaaataactaacactaatgacagctgatgagctaaaaaaaaaaatcacaaaacaatctcataatgttttaagaaagtttatgaatttgtgttgggctgcattcaaagcgcttctgggctgcaggtggccttgcaggccacgtgttggacaagcttgatttacaccattcattcatttacttatgtgttcctaccattcattcatttacttatgtgttcatacaacaagtacttattaagcttctacaatatgccagactctgaaagagacagtggggaaatcaaataaaaatattaatatctattccctgtccacaaggaaatggatgactgtacaaactgggagaaagatgctgcaaacaagagaagggaaagagttgatggctgctggttaaaggtttccaagagggccaagtcttgcagctgaggcttgaaggatgtccaggggttttttgttgcacaacagtggaaacttcttggaaagaaagaagtgagcatgtggaagaatcttccatgggcagggaatagaacaatgtcgtatgccaacatcagagaggttgagagggcaaaagattagggaaactgtgttttagcatatagacagttccacaagtatggcaaagatacggaacaacaggaaatttcatggaaaagaaaacagacctcaaatttataatgccatccaagaaagaggatttagaaagagtttgagggattttgaaaactaacaagttcataaaggtgttaatttcattatgctgtaaaatttatttatgaaaattttagctcattctacttccctaaattttttatttagaaaagtatattaaggaaaagaaccactttcatctaaggcttaaaatgcatatgtcaaaagcagaactttctggttatttttaaaacaagttaaacttattaatctggtgtttatcctattgactgattttaaaattttttaatgaatgcattttcatttctagtaggttctttatcacatctcccttttcttattgaatttctctctgttcctattacaaaaacacgattctcttctccataatctcaaaacaactaaacttacttattcttaagctcttttgagaaaaggcaattctgtatttccctgtgcttgttgactatttctcaaggatctgattttatctttgtcttgtaatttttgtctgacagctcatacgatgtaaactttgttccctgtgctgtgatttggggattgacatagcccagccagataagaagcatattctgaggttagggcgtgaggttcttttcccaaagaagacgctcccacaaggcactcgtgtgcaacagaggcacagatcctagtttgactcagtgcctctgcttccttccatgagagttctgtgtctggcttcaattccagagaagatgtcaggttccctttgagtccagtctatgcatgggggtcttggcctccaggtgtacaaggctcttgccacatgtgatgttcacttccctatgtgtccactgaagtcaccattgccccatgtcatctccacttcttgggagtagcccagtgtcagtcttctctcaccactctacactttctttcatttccggtccttggaggctttccacatatgtttatgcttggttatgtattcactaaaatacattttaaaatattttatctgtaattctcatgtgttcaaacttcagaggaaggctttgtgcacatttcatctggactggaaaaccaacaagaaaccttcaattctgtcttggaatcactcaaaacatttcaaatatgacaattttaaaggggaagaataactttttcacttaaagaatgggatacaagaggctgaagagtcagagaatgaactagacacagtgatttatgtacaacttgatcttatgcttgcatcaaagaaaaacttgcttttaacaacaacaacaacaacaacaaaagccaaagttttttttttttattgtttggattaaatgaatcgcaactgctaatcactttatggtcagagactagaggatgattttgaagcatcccattcttcaatgtccttgatatagacataaccattataacgtatatttgtcaacttttttggtatgttaatactaggggatacttttctttttggctgacccttcacagcaggaaatttctagggaaatacatcatctaactgtttacagttcaattgtcataagtatgacttttctaaagttagtcagcaaaagagggccaaagaaatgcaatccaacacattgagattttacaaacatctgcttgcttccccctccctttattaagtatacatcatgcatcaaatctgtttttaatcaactaatacatagactaaagcctgtggtttaaacacattgacctatccagatcctttggggttattcaaatttaaatagtacaagtgttactgaagtctgcaaagaattaccgagtcagttagaagcataataaagggaaattaagctgggagagagacttgtttccaagtggtaccaaaggggctgacaacacctttgaagggaacctgggtaatgggaagataacaaaatccagtccttaatgagccatgcacccataagcttccactacagggacttctctgaagattttctggaaattaactctatcactaacatcctgtgtggtagtggtcagcagtctccataatctcttgattttgattgtgacttgtgcaaaacagagatcatacttttccatataaaagtcatgggattaagtagatatcagtttctatactgccctatggatatctaaaaaaattctacagagcacaagaaaaattggttttagtttcctgttctcaccttgaaaacatcaatatattgacatctccttactcaaggcaagttttgtagaaatccaaggagtcagtgaccacatatgaagagggaggagaccgggactaccatcccagctggactctcttcggcaaatgactggatgtgtcttgggctcagttttcccatccataatgtatggataatgataaatctacctatctatactattgttaagatcaaatgagaaaatgaacacattcaccagagaactacatgaatgtctgttgaaattatgaattagaagatggaacatttagtttggacacagttccagacactagaagggcccaaccctgtgcctctgggaggcaccattctccagcttgctcatggctttttcctgcaagcacctgtgccttttcaccccagggccttacctggcttcaggcaaggcaggtgctggggagagtaagaagaagctgatgttcctaggagcagccctcaagtggcaattactggcaattggtggatatgcagcccagctttttcacctcctgggtggaaccactctgagcctctgtctacaaaatctcccacagggcgcaattgggaggcagcacatgggtccacagcaacaacctgctcattaaccctctttcctcttcaatctcttccctgtttgcatcccctctccctccaggtgcttcctggatcacctcccaattcaaattctgagtcagagtctgcttctgggagaactcatctacgatcatctccatagaccacctaacccatttttgcgtatgcctttctgtgaggaagagccaaatcagaaaatattttattgctttagaaagacatttgcaaatacaagaggttttctctctttccccatctttcctctttctgcttttcctagaggtcacatatcctccaaattccaggctgtagatcagcagtatcaatagaaacctaatgtgagccacaaatgtgagtcacatttcaaatttttctagtagtcacattaaaaaaaatagaaccaagaaaagttaattttaataaaattgtcatttccacctgcaatcaatatttgaaaactgatgagatattttatattttgttctttctttttactaagtctttggaatctgatatgttttacacttatgacacatctcaactcaaaccagccccatttcaaacacttgggagctacatctggctggtggctacctcactggtctagaacagggggtggcaaacttgctataaaagatcgtgtagtaaatatttcaggctttattggccatatgttcttggacacaatgactcaattctgctgctgttttagcatgaaagcagccatagataacatgtaaacgagtggataggactgtgttcaatgaaactttatttaccaaaacaagtggtgagtgagatttgacccacaactgttgtttgccacgcccccagcctagaaggtaaaactcaaaatgataatattgtctgggccactgataaacatctgcttctgttaaacactaacatttgtcccaaactttttgtgtaagtctgaaatagatgccactcaatgaacctctaggaagaattctttctgtacaagatgctaagagcactttcacttatgggcagaaagcttagcttgacagaacccacaataatctgaagaaaattaaacagcattttgactcgtagatattctaatttaaggagcataatggttaagtacacagaacctggtgccagtctgcctggtttgaagtcctagctctgagaccttcaacaagttcttaacctctgtgcctcagtttcctcatggggctgtcaagatgattagaggaggagatacatggaagccctaggaagagtacctggctcacgatgtgttgtatcggtgcttgttaaataaaataaaaaacttgtttttcaagtttcgagtttagactgatttttaaaaaaagcttaatttgtaacacttataccacaaccaaattaaaagcatgcccatacagttaataaaatatttaaaccaccaccaaattaaaagcatgcccacacatttcataaatgatttgttctgtagattttcaatttagtagtacatagctacaagaatatatttccccctaagattacattttccaaaaacactgaatcctatttgctcagctttctcatgatgtgattattgtcagaattcccatctggactgcgggtccctgttttagactaagtgtacatatttctaaaatgttgtgcaatgtcctaaatctcaatgaatgctaatgctactatttgttgtcatctcgtccatgaagcccttctcatctgttagtttgaatgggcaactccctttcctttcgtggtcagtattactcatacctcttttcctctactttccccactcctgtgctgtgctcctgccattgtgaacaagctgttttatggatccaggcttgtttctgggtctgagcatgggcgcagtctcttccctttgcctggaatgcatgtgtgtagcagaaaattctaccagcaaaaagagagtataataaagccacaggatgtattgagtacttgctgtatacccatcattgcttagtcccttcccaccgtacacccttaaatatgcaatgatatttccaattagcatggaaaactgaatattcaccggacaacccttctgaaatccaatgtagtaaatcaactgattagttaatttaacaactagtgtagatagttaagacaatgtcttctctcagctttgctaaacaacagaagtcttccatgctttcaggcttttctcattggtaccgttgagtctgaccccaagaagagggccttgagagtttagaagaatttttgaggaatgttatataacactgtccagagcacaggattcctgtgaaggcaaatataacattatcaaacaaatttttccaaaccgggatttataaaaatagagagatgctatagcaattatcactaacacatcaacttcaagttccatctaaacccaaagtcaagttgctcccagccttaattcattaccttttccccaagtgattttttcatagtgctcttattctgtgaggtttacgacttggtggcattcaatactaccctcccaccactaccaccaaagaaaagaaatacaaataattcaaaatggtccttataaaaggcaaggatacctgtgggcagatttagtttcttaatattaagccaaggattgggtataggtcaaatttgtggaaggcaaagttataaaacatgtgttgcttaaagaatgaggcttccttacatactttatgcaaaaagggtgattaatttttcttataatttttatttttaatgcacacattttggatgcatcttcacagagccacagtcaacctccttcatgttaggtagtttttagtaaggcttatttgagctgataattgaacaattcatgttgggacagctgattttacaccaatctcaatatgagcctttaggcatggatagggacaccagcagagaatagtaaatccaacttaacagatgagctttgtacttctacatacagtgatacccaatcaaatagcaagggaagcagacaaatgcccctaattttagcctttggagacctgaacctaagagtcaggttgcagggaattaatgacttgtcattgagcactactattaaaatgtatgcttgaaacaggagatttcagtaattccttttgggtttgcccaggacttaaagaatgcttgctcttattccgaagtcaatacttcagaatgtctttaaagtacaatattaggtctggatacctttcaaggcaaacacagatctggcttgtttcattccataatattcagagtgacattcagcaactgtattcggagccctggcacccaacaccaccactccagcgtgatcaggatatggacacgtcaagtgccacgacccatatattttcttctaagaaactttaatcacaatagttaatatgaaaacacacccatattaacacatgccacttgtataaaagcataaattctttatatgtaactaaattttaaagatgttttaattgcactgcaggaggctgagactatcttcaggtttgactcgacagaccgcaaatacatgtaatttaggttgttttaattttttaatgcatttttttcattggttataatagctaccatttccaaatgccctggcaagacaggccgccgagggaacttcaaaaacctaataaaatacaatctgcatataaatttaagtctagtattccatggactacaatttaagtcattttgatatgtgatacagtgtttaccttgtcaggttttatttgaaatttctatattaacaccacagaatctgttccatatatttataaattccatcattaggagttcagtgtttatttttctaacctggtagtcaataacatacagagaacaacttttaaatactgtgtatggtctagaagagcttttattttaatggagataaataggtatcttagtatagttctattcatttagttataattttagcagatccaatgacgactagttatttccaggtattagagatgtgaatggccttttttattcactcctcctccccagccccatttctgcctataataagagaggtgagcaaatgaccaataaatacatttgttggttttgagaatggatatcacatgaagctatattactagaatcctttcaaattctctaacttaaaaacaatgatctcagttgcaaaatttatgcctgcagaaaaatgcttctaagaataagtctataacttttatcagcaggacataaaggaagcattttgtaagactataacacagctagaagagctgtggatggtccaattgggcaactctctggcagccctctctgctcatttgcccttgttcaacttctgaatccttctcaacacagtactctgggctgccatagcaatatcaaaagaggccacaggcagggcactgtggttcatgcctgtaatcccaacactttgggatgccaaggcgggaggattgctttaaaccaggagttcaagaccagcctgggcaacatagtgagacccccatctctacaaaaacttttttaaaaattaaaaattaatattaagccaaggattgggtacaggtcaaatttgtagactacagctggtacacatctgtaatcccagttactcaggaggctgaggagggaggattgcttgagcctgggagttcaacacttcagtgagttatgattgcaccactggactccagcctgggggacagaaagaggccctgtcttttaaaataaataaataaataaaacaaaagaggcaatctacttgccagttaagaattacatggtgaggaggatattgtagaacagactaatagtagttaattatttttgttcaagtgaaaactttcaaatcaggagatattcaatgtcctaaaccagaggttggcaaactatggttggtccactggtcaaaccttgcgtgccgcctgtttttgtgtggcttgttagctaagaatggtttttttttttttgagacagagtttcactcttattgcccaggctggagtgcaatggggcgatctcagctcactgcaacctccgcttcctgggttcaagcgattctcctgcctcagcctcccgagtagctgggattacaggcatgtgccaccaccatgcccagctaattttcgtattttttagcagagaaggggtttctccatgttgctcaggctggtctcgaattcccaacctcaggtgatccacccgcctcagcctcccaaagtgctgggattacaggtgtgagccaccgtgcccgccctcatttttgcatttttaaataattttttttaaaatgaaaagaataacattttatgacacatgaaaagtatacaaaactcacatttctgtagccataaagtattgtttactgttgctttcacagtacaatgagaaagttgaggacttgtacctacaaagaccaaaatatctgctatctggccatttgcagaaaattgttttccttatttaaaaaacaaccttctctttttaataatccaagaaagaaagaaagaaaggaaagaaagaaagaaagaaagaaagaaagaaagaaagaaagaaagaaagaaaaagaaagaaagaaaagaaagaaagaaagaaagaaagaaagaaagaaagaaagaaagagaaagaaaagaaatccctggtatccatgtggatggtaaaaaaaaaaaaacagtccatgtagtttttaattaatttatacataacattttttttctgttgctccaagccattttaaaatttcaatataattcaattaacttaacattttcaacacctactatgggagtgtaggaggatgcctcaaattccaatccttcaggtactcaaaattctaaagactctttttgttaaccaccaaaataaattttaactcagaaaaaaattatagataagatgtcttaaattatggataaaatgcaatgattgaataaattcctgttttatttgtgtcttttgtccaggaaagcaggagcttcaaactgaggaagagtaagaaatgacaatcttcaattgtatcaaggttgctatagcaaaaacatggtcaaaagtgagtaaggaaggcacagcatgaggattagttagttcctaccactctgcaaataaatatataaagcattgagttttaagtgccgactggataaggaattactcattgattgctatcttcctcaattctattatcctggtctttttttttttcctcaatcataaaatacaccttaaaaggcaggcagggagggtgtagagcactagataattaatgtctataaaatcccctgatactgatggatgtcatacatgttgtctgtataggccccttcaagctttacttcctccatcactcagggattgaataattttgatcttatcccctttcttccatcttaagtagatgataacattgccagatactcactaatgaacatgttctggtcttcctacttcaacagggttttaactgataccatcaaacatttttaccagacctgaatgtcaaattagtctcatagtggatgcttagccttggatggatgaaaatacatttttgtttttcagatactgtaggaaaaccaaatctttttctaagccagcaccacgcatcctgcaggtacttcatgtcagttaaactcaatatattaaacatatttgaagctaaaatagttgaaagtctttgatctaataattttgaatagataagtatgatttcctttttttctataggaatttatcttctgaattttttaggttttagaggaaaatgcccttttctggaccagctgctgaaaatgattattaaaattcaatacatgatcagctttgttcttgaattgtggcattcaaaggaaaggttcgtagctttcacaatactcatatccccacatgtgtggtacaaaaaaatatttaaggccaagggaggtcacactctttggctcaaaaaaatagattaaaattccattccatccaaagtgggtacgatctgtcaggaatttacaaaatcaatattatgtaagagaattccccatttgggacatcctacagaatcaaagaagaatatgaaagcatgccattgtttttcagctctgaaccttcaaaaacagacccttgcctaagttttgaagtttgaatctcaaattcttaaaattcattgcatcctttgtccctgacttcatcatctttactcagccatttcctcaacctttagtaggaccgacactgcctttgtctattcaagatgatttcgactgagttgaaagaaatgtggaaatcatggaaggaaagaagatgaggagtgtctactaggggagtagttcccattctggcctacacatggcaatcacctggatctatcctcccttcccaaccggagagtataaataacttcgcctgagtgaggtccagggagcaggatttgtgaaagctacccaggagattccaatgtgcatccaagttcgagaaccattgctcaaaatggagaaacaggttctgtgatacagtgaaggaaaatcaataatttattcaatttactacttttatactttaggatttattcagaataaaaatatatttgtaatgcagcttatatgtatataacaagtacaggaataaaattatatatagatgtatgtagaagtataaatttatgtgattttatcatagaaaatcccagcaactttattaaaacagtgcttagcggggaaacactgattgttgctgttaaggaatttagaggactttttatacttgaaaatataagggaatgctttcttgcattcgagtattcccaatgcctaaaaagagctactgaatggtcacctcaatttctaatttgccaaagcatttgtatacaaatttggtctgttgaccttaacagtagttactttcaccagaaacacaacagaagtgtactacagatgtttatcattcaacaatattttaacacatttaacttaaatatttaggaaaaacattaaaaaaattctgacgacaaaagaatagatttacagctctattcactttcaaacgtcaactcaggcaagagcattgccctgaagccttgtgtagtctaaaaggtaaattgcaaaatattcccaatatttggaaaccaaagtgataaagtattctgaggctgggcatggtgacacacacctgtcccagcactttgggaggccaaggctggaggatcacttgaatccaggagtttgagaccagcctgggcaacatagggagaccctgtctcaaaaaaaaaaaaaaattaaaaattagctgggcgtggtggcatgcacctatagtcccagcaactccggaggatgaggcaggaggatcgcctgagttcaggaggtcgaggctgcagtgagccatgatcgtgccactgcactccagcctgggcaacagagggagacactgcctcaaacaaaacaaaacaaaaacaaagaaaaccacacctagtattctgcttctttgattgatggccacttgcctggggaaaaaaaaaatagattttctagaaagtgatttaatttgctgtgttttacaaaaaatatttactaaggcattttcccaatagcattcatttgtttatacatgactaaagacaatttatgggtcactgtattttggaagtgaactagctctcagttccctgaactatatttgagtttacatatacaacgtgttgctaaagcggaagtcaaataataaatgttactttcaaaaacttttaaaaaccaagccatttgcttttaatccagtgagagaaaactgtccaatactcagaagtggaaggagacttgccagttataacaattacaaattgcaaagtctcatcttttctgtagaatctagaaggtagaccaggagttctcaaaatgtagcttggcccaaccacagcagtcacctggggagccggttaaaaatacaaattgttgggcaccttcccctgggaaaacagaaagagaggaaaagctaagtaggaagtaagcaattgctctgcttctctccccactttccctttcttgtggacattttgttatcttattacttactaaggctttgtaatcaggtcccattcttgggcctttcccgagttccttcagtctctactgcggaacaggaagcagaactgaagagagagctagagaaggtgtaagggggttatgagccaatgtcatgccacacagaaggttcaggcatggatgctgcacctcgatcagctgtgctttttaacccatctgactggcagttctaaattgctttttctaataaaaatgaagatagaactcagatgttcacaacgtgccctctctcacacgcaaaaaaacagtcatgctgaagttgctcccagtgtattcttgattacttataaacgtcgttcttaaaaaaaaaaattaagtggtattgaaagggggagagggcaaccagccagcagaggatccagactcatctgtttatgatgaaaaaataatgcccccccaaccattggttggactcagtgtacctcttcaaaattcaaaattcagcttgacagaaaatatataaagctgaaaacaaacatgttaaactttgctctcaggactttttagtgtgacttttataatttgatttccaaatgtctgtgaccttcgtctatcactgtgataggacactctggggaggcagtgtcacatgacatcagacagcttaataattaaatggtgatagtaaatcacaaagaggacttttggccttccacaactgttatctttctccagtgtgctgtttttatttgaataaagtgtcactgatacaggtaatgaacaaattctcaaatcgaatgcatttactataattaaaggcagactttagcactgtgcaattttgactgcaagtgagtttcccaccagaacatgttctatccaaacaattataataaaacagtggcttcatatgtacatattccatcagcaatggcattctttttcacagctttaactccatcctctgtcctgacacgattcagattttgatctcagatctcaactctgacctaagctttagtctctcactatcagttcaataccaactttcagctttgctggtcccctgttattttaaactcaactgtcttaaatgcatcatctgttcctttgaaatttctccccaccttccctttatttatttatttatttatttttattgagacagtgtctcactttgtcacccaggctggagtactgcggtgtgatctcagctcactgcagccttgacctcccaggttcaagaaatcctcctgcctcagcctccccaagtagctgggactataggcatgtgccaccacgccagtctgatttttgcatttttggtagagacgaggtttcgccatgttgcccaggctggtcttgaactcctgggctcaagcaatccacccaccttggcctcccaaagtgctaggattacaggcatgagccaccatgcccggcctcgatctttacaaaagatattactatgctcttcatgtcttctatctaatcactctctaaagattttggggagttgtttttttaaaagactccttgacttcagttttcccttttcttcccaaggtttccattctaacaatcttccatgaatcactggttttcattcctctaatttttgtccagttgggtccacacatggccgtcaacgtaatctttccagtaagcttacatcactctcaaaactccaaaatttttcaactcttaaaggatgaagttcaaactcctgagttggcgtgcaaactcatcaaaactataggtttaaaactttcccagtagaaggcagctataattaccaccaccctgcaaaatgaacattcaacttcagcaaaactggattcctttttggccaataaattgtgccatgtctactgctccttccaagctctcagttacgtctttctactaaactagtattttgttgttgttcccccacaacatcttaacatctagcgggttggctgtgcaaatagaggcactgatgaatgtttgctcaataacagtacataaataatattaatgcaaccaaagatttcctgactataacagaagtcatatgaagccaaatcttaattccatttcaaaattggatagagtttaatcatatggttctgaagacatcaatgcatatttaagacatcaagccatagttcactgtattataaaaacattttgattaaattagtttcagaaattgctctctggccaaggagctatctgcttcacaatggaccatgcaataaatcttagactacatgtgctgacaggtataagatgatttattgaaatgtaggatgaggaattgtgaagcattactaagaaatacacactttcttccaatgtaacattattttactttacaaaagtaatttaggaggaaactgtactatcaagataatagcaaacacttcccaaacatctctaattctacatattaaaaataatccaagaatgaaatcattagatcgtgcggctggctctagatcagacagatgacttaataatgatccatctccctataacaaagctcacctctgttaataatcagagaatttatactatctgtgaccttcaatattgcttcaatcatgtgctagccctaggatttttaatcttttatttgatttttctttgcaatgttattctattttacataatgatgactaaagagattgagacttcactataaattgagattcttaaaataaagctgcttctgaattcaaaacaacaagaacaaaaccaaacaaacaaaaaaagaaactgagccacatatgtaactatctcttcatgattaaagttgattataatgatctcctgaattttaccatttaactggttttctgagaattaacactatttacagctacagtttcctcaatagccaaaaaaaaatcaaaccctctcttctcttttcttttctttctgttctttgagacagagtctcactctgtcagccaggctggagtacagtggtgtggttacagttcactgcagcctccacctccctggctcaagtgatccttccacctcagcctcctgagtagctgggaccacaggtaggtgccaccatgcctggctaatttttgtggaagacacctgggctcggtgcggtgtttcacacctgtaatcctagcctaggcgggcagatggcttgaggtcaggagttcaagaccagcctggccaacatggtgaaaccccatctctactaaaaatataaaagttagctggctgtggttgcacatgcctgtgatcccagctactcaggaggctgaggcacaagaatcgcttgaaccttggaggcagaggttgcagtgagccaagattgtgctactgcactccagactgggtgacacagtgagactccatctcaaaaaagaaaaagaaaaaaggatcgtggaagacttctggatactgcctgcaggcctttagatagtatatcccagggcctttacaatgtttcaagatctgggaaatttccatattcttcctaacaccaagtacttaacaaggctaaagaattctgcctgtgactttaatctgtttcctgggctgttagtattccacacaaataattctagttgttacctgcagaacgtcctgaggttcatagtaagaagtttgcgactaaactagtttaattataaagcctgatgcattgcttcaaagtgagagtcagtctgtctttgattgtctgagacccaatatttcatccgtggagtcacagatcacaaaggtctattattccaatttagatggttccatctaagttggatgtgcactgtgcataatgaggatctcatccaaatagtcaatttggtgaaaattaaatcgactagtgccaatgttctctagtaacacatactgaggttctccctgcctcttcttacagttagacaatttagggcagaaaagactcatgaattcccttaaaaggaaagcatccttaggacaagacccaggttgctctccctccccattggattcaaagcaccgaacacagtatttgctgcatagtagtctcaacaaatatttgctaaagaaatgggcaggtagatgggtgagtaggtggataacggttcctacagagtttgagaaaacaatttggcactttggtttcaaatcctgggaatgaattgagagtgcagagtgctctcaaatttcagagctatgcgggtgctgcctgggagttgaaagtttttccagttctcttgaatgggcactcaggttctcttgagatctgtctggaagagtccagttacttgtcatactgacattctacggaaggtaccaaatgcaataggtctaagctatctccttctctgctaaaaaacacaattctctcccatacatgagccgaaaagaaaggcctcactctcagggctacctctactctttgcctggaaagatgctgtcacatgttagcaggtgaaattagcagacacttacttatttttggattacaggtaaacagaaatcaccagttcaggtgccagtaataggtccccctgccctcccaccaccccccagtaaatcacagctggtgactacaacttctccatatctgaaatcactaactttaaaatgaatatctgaataaaatattattcaatgtactccgaggcaggctttgtgcacaccatctcttttgatattacatataattgatatatcatatatcaattacatatatcaagactgaaaaacacaaggctgttgattgacaagcattttctttcctccagtactgaagtacgatagaggttttttaaatgaaaactctactaaagtagtttccagttctttgcactttgtagtagagaaaaagtatttcctaacacataaggctggaattgtagtttagcatccatttcaagcagctctctagaaatgtaaaaaggaaattgcaaaaatgagttcaaatcacaaaatataaaaatcccaagtgtgaattttctgaacaacaatgtgcaattaagaaacaaatagaggaagggtgggagggtgggggcttcaagggataagcaccttacgctgaagtctttggggacccccattgctaggcatctccactggattttccaggactctggttcatttatttctagacagctattttaccatacttaagagtcaaatgatgggagttttacccccattaacggaacttagtgtggacagcgttctaatggcatagaatggaatttggcaaaatcaacggccatttaaaatggttaacaaacctggataatatcaattaaatcattcatagaattttaacctaaattaaacattaccaatgtacatataagaagcatgttaaaacaaaacaaaacatccctcaactctatacatcacaagtattaatgtgtttcgcagactttttaaggctgggatgaatccaacttgaccatgtgtaggctgtctttggcaatcatatgattttccaaaacaattataaaaataaaagaaacatttgctcattgctactagtgtatatagtgtctccatagggtaatttgtgttgctggactaaatgctctgaacctttaaaaaaaacttatagttcacgacttagcaaggtctgccagttgtaagaaatgtggaagtcataatgaggactggaaggggaacttaagacccaattaatgtggtaattaacgtcagaaatagtgtctaaacaaaaaggtgaagaaaaaaggggtggacttgaacctttactgttctaaatactttctttttttattatcattttacatgtttagaatgaaaagcaaaatgtaaaaaatgaccatagatttaatatactagccagatttactgggtagtaacttactaatgacaaaggtatctttgtgctaatcttagtgtcttcccatccctgactaggatcaataaatgtttgctgaattgaattggagtacacactgacattaggttggcaggagtaacggaacattacaaagatatggcaatcaggtcacattagaaggcaacatcataattatatttgagtttacttttattttggatgaaaaaaagaatttctaatgcaattccattccagttcattatgtggaagtcttaattcaatgactacataccaaacacataataattcttcctcatgacacattccctggtatataagtgctcacaataatatccacgtaacaagggctacatacactgaaccaatttgaagtgtgttaggtataggtcagctttgaaagatcaaatattgaccatgagataaatctcaacacccttgacaatattcaactttggaacaataattttcacagccacacaagtacagcactgggaatgtactcaggctctcctatcaacgatggtcctatcattctccttaagttactcttgggtttatctgattccaaaacacttggtcattctcctattcctgctagaaaggtgggctacagtgaggtaacaactcatttgtttagagctggataaagtggcttctttttccacagtcctccttgtttggcagtagaaataatagtaggagtcataatagtaacaatgagaatagcagcagtttagtagtagcagcagctgtagtagtagcagtaacaatagcagctaccatttattgaacacatactacatgcccagtattctgcatattctatctctagtcctcttaataatgtgataaggaatgtatgattaccctgatttctagtgatggagagatgaactcagagctgggtgtggtggctcacacctgtaatccaagcactttggggggctgaggcgggtggatcacctgaaatcaggagtttgagaccagcctggccaacatggtgaaacgcggtctctactaaaaatataaaaattagctgggcgtggtggtgtgcatctgtaatcccagccacttgggaggctgaagcaggagaatcactggaacccgggaagcaaaggctgcagtgagctgagattatgccattgcactccagcctgggtgacagagcgagactctgtttttttaaaaaaaaaaattagccaggtgtgttggcatgcacctgtaatcccagctactagggaggctgaggcaggagaatcgcttgaacccaggaggtggaggttgcagtgagctgagatcgtgccactgcactccagcctgggcaacagagtgagattctgtctcaaaaatacaaacaaacaaacaaaatgtactcaggctgtttcccagggttacacgactagtgatgccagcgctggaactccaaaccagttccatttgatttcaaagcctgttctccccacacaccatttgacttctggagcaaatttatgtcttgcttcttatggcatcgttctttaaaaagtcaactcatttcattcattttttttttcatcccttgtaacatctccagaaaatgcctgttatgattgttgcactggtttaacagattgagatgccaaagacttagtgcatcaaagggaaagttgggatttcccaggttacacttaagggagaaaaaaaaaagtgaaatgtgttatctaagtgatactggttagaaccaaagagatttgaaatcttagtaaacactaaatgcacaatgtggaaggcctcttttgaggaggggaaaaaaaagcatgcttggaatttcttaccaggacttaattaaaataccttaatttgggaaatgtttttctacaatgaattgaaatccttaccagaaggcttttcagaagaagggaaatattgctacattttaatatatagctcactctaaataaaaccagctctgagtcattgacctaatttagtttcacaaacagtattaggactgcatctaatttaacagtagaaatatatacagtattccatgtcagcatccctttaataccacaaggttctcccaaactcttattatgggataattcttatctagctctctaccaattatagggagatttatagcctggcgaaagttttgattcaaatttgtaaggaaaggctaatagatgagctcagatcaggtgaaaatgttgctgtcctatatagtagaaatgcaacataattatgaactctaatttgtggaaacataggctatttcctttcaaagctaagtgttttttgtttgtttgtttgttttgttttgtttttcctgagactgagtctcgctgtctcacctaggctgaagtgcagtggtgtgatctcggctcactgcaacctccacctaccaggttcaagtgattctcctgtctcagcctacctagtagctgggactacaggcacaggcacataccaccatgctgggtaatttttgtatttttagtagagacgaggtttccccacgttgaccaggctggtctcgaactcctgacctcaggtgattcgcccaccttggcctcccaaagtgctgagattacaggcatgagccaccacacccggcttcaaagctaagttttaaattacatgtgtacaccttgagttacttcagaatttcaacaagaaaaaatacctggatagaagtgtttttgtaaaacccaaagtaaagaacattacgggaaatttcggcctttctttcgttaagtgtgggatcttgaacccagatgaacgagactttcaacatattgaaggttatcatgatccaggatgacaaactctgaaggtatttttgggagcctgtgtcttttgtcctgcctaattgacataagaagataaaacattgttcttcacccttttcccactctacaatcatactttcctttagcacatccagtaacccctttgcctgcaaaaaggatgaaagaaaaaattgtaccaatactcaggtcagaaaattaaaagggagggaaacattcctggtaaacaccttcaaaatggtttgtttgcttgtggtatgatgattgcttctgaatgaaggagaaggagaaggagcaggaggaggaggaggaggcggaaacatacctatttgaaagcccaataacaagctggtggtttgttttattgcttttttaacacttttatttatcagttcatagtagtcatgattctcttgcttattttatcttcgttttttttctcctttagctctatgcagcagtgttggctgctgcagtagatgaataatagatttgaataagctacaagacatagtttagattttcactgcttttttttttaggatattgccaatgtattttaaatggaactcttacacaatagaacatcctacagggatttcctatggtagtttaagactttacaagacaaatggctgggccccatgaggttgcctccttcatcctgccatgggcattttgggcatgcctgaaatgttctagcattacactctctgattgttgccttttactgcatggagtttattatttagaaaaaaaagtttttaatattttaaggtaaaaattatttcctgtgcaacaacagcaaaaacacacacaaacaatatttagaagctgtaaaatgaagaacagttgattcaattttgaaagaacgaaagatgttctgaaatgctttggtttggttccatgaaaattctttgaatttcagccatttataaatcatcgttcaataagtcgctggcatttaatgaccacatgatagatttatatatttttatatatcttctttatagctgttttctcaatgatactgtgaaacaaacaaacctatttttatagcactttttttttatgcctgttgcctgtcctataaagacaatctcaagtgcagaacttccctggataaagatcagttcaatcttcagcagttgtcttatcacctaacactccctgtcagaagaaacccttggtattaactcatatcactcatcttctagaacactccttgggaacactttatttcataaaatcccttagggctatataactctcaacagtactagaaaatgactccccactgagactcaagaatcaaggattaagccagtagtgaagttttactagggtggagtgagcaaacttaggtgttgctgtcctcacatatgtgcgagagataaaatcatcctccagtatgttcctccctcttgcatttctcctaatcatagacacttccttgaagaagacagaacatgcagcctaggctatgttatgccaaagggtagaataatagtaatggtactacagggaataatttgtcatcattgaaagttttgggggccaggtgcagtggttcacgcctataatcccagcactttgggaggttgaagtgggaagatcgcttgagcccagaagtttgagatcagcccaggcaagacggcaaaaaccccatctctacaaaaaaatacaaaaatcagctgggcatggtggcacatgcctgtagttccagctactctggaggctgagccggggaggtcgaggctgcagtgagccatgattgcactactgcactctagcctgggagacagagcaagatgttgtctcaaaaaagaaagaaggaggccgggcacagtggcttatgcctgtaatcccagcgctttgggaggccaaggcgggcggatcacctgaggtcgggagtttgagaccagcctgaccaacatggagaaaccctgtctctactaaaaatacaaaattagccaggcatggtggcacgtgcctgtaatcctagctactcgggaaggctgagacaggagatcacttgaacccaggaagcagaggttgcggtgagccgagatcacatcattgcactccagcctgggaaacaagagtgagactctgtctcaaaaaaaaaaaaaaaaaaaaaaggaaggaaagaagggagggtaaagaaaggaagagaaagaaagaaggaaggaaagagaaaagaaaagaaaaaaagaaaagaaaaaagaaaagaaaagaaaagaaaaaactaatgaacaaaccaggcattctactcaatcctttaaagcacaatctcatatattctcaaataagccatgaaaagcagtcattgctgaacccactttataatttgggaactcaaatttaaagatgttcagaaacctccccagagtcaagcttatctgaggcagagagaaaattcaaattaaggttggtaggaccgcaaatcacctctaaccaagtatgattaaggaaaccttaataatgccaggaggattactgcagaaagcttcagagaaaaacagttcactgcaaccacatttgccagtaccttctaaaagttgtaaggccatgatcacacataccatagaactaggcaaaaagagaaaaaatagcatgacttaagtgtacaattatgaaaatgaactgttgttattatgcatattttaattagtatgggaagccctcataaattatgatcactattatttatgtggccaaattgattactggattattttaatctaccactgtgtgttccatgtcccctctcaaagctccctctccatgaggctcctctccatgcagttattatctctatgatacccctctctatgatgttattctctatgatttccctctatggtgccctctctataaggcccctttcaataacttcagttcaatgatggcatcatacagagggatgtcaatttgtgaaaaacaaattgattttgtttttccatctctagtgtttatcccctcagggaaatcattgattgaacaccattttataatcgtaaataagacagttttgttttttcaggacatgaagcacttttattgaatgtgttatttagataaaaaagggaagaggtagagtgactttctctgaaaaacatagatacgaagtaattgccaaatagagataaattaatctccaaggaaaatgaccagatccagtggctttttaacatttcaggaaccctatttttatgagtgtactttggaagaaaggctatacaaacagtgaaaaatacccaaagtttcataagtaccaaacacataactctccacattaattgtgatggctttctttccacttcttcagccttagtccatgctgtttcccaaggactcgtaggaagcatctctagctattagatataattcatattcaaatttactcagatgtattcaaaagaaatctgagataaagtatctccccatgagtcatcagcacagtaaggaagaattaagagattttcaactgattcctttactgggtgaaaagaaaatcagatctccatttttcttagctgatttttttttcttgcttgctttggtggtctgatcacgctgtctcattttctgactttctagctgaaaaaatttcttggataggaatattattgtctgggttattactttagtaaaacacatatactgtgattattactttaaatttggtaaataccatcaaaatgcagacctctcataaagacacagataatgaaaatttctgcgctctagactatgagtacctatgctaagatatttgccttaacttacataaagataattattatttaacctctacagaagttgggtatgttatagacactgcttcaaacaggaaaactgcatctagtagaaggaagatcacttgttgaaggttagtctatctgtggcctagcatatgggtttctactaaccaactgtgagatctaaaccagaggttggcaaactatggcccatgggccaaatccggccagtcacctatttttatagagcttcattggcagcctgccacatccatttgtttctgaattgcctatggctgcttttgagcagttcccacagaaaccatatggcctgcaatgccagaaagatttagtagctagtcctttacggtgtttgctgacttctgcctttatgaattaatctgaccctcagtttactcattgtaactgaggaattggaaaagaataaactttttccaccaagtttgcacattagaatcacttggggtagttttggggaaaccccaatgcctgagctgcaccccagaagatcttgtcccattgggctgggcttctgcccaaggtaatccctgtgcagccaggttgagaaccactggactagatatgcgtgatggcccttcgagctcagcgctttcatgacatgaacttcttgtgaaataagtagtaccttccagcaggaacaaatgcttggaaattatgactgaataaattcagcctcagcaatgaagactcacatctgatttatgctattccaagtctctgacttgaggagtttagaatccacagttttgcaaggataaagacgcaatgctatataaatataaatggttcctttggaagaccaacttaaaatagactaacagatttaatgagttaacttttgatctatggaaataattcacttttaataatatcacaattaaaactattatacatcaaatataagccatttgggcgaaagtctcagctgccagcctgttctctgcagactccccacttggaggaaagcctcaggctctcctgtctctgacacagacggctacacctggaaggtagtcctgaaaataagctgcaaacactaggaaatctaggggatagcagataatatcaaatacacctaaatcatgttttgggaagggattaaagaatatttcataagcctttggaggtttaaatactgttgaaacagcctgaaggctggcatgtgcgggcccagactgctcagagttgggctgggggcatgggtgagagaagcccgctgtgcaaagaactctggggctgcttccaggctgccaggctgccaggctgccactcagggcatctgcagatggcgggaggggagttctgcaatgtctcagctctctacatctcaaagtagatttggtttaggggtcacacaaacaagtaaatgtctgtaagagtaaaactgagcatttctcttatgtcattaacaaagatgctttgcttcgactcagggtatctccgctttggcaccaatgacatttggggctggatgactatctgtctggggggctgttctgtgcattcaggatgtttagcagcatccgtggccttgacccattgtgcgccagtggcagccccttcctctcccaagtttcgaaaactaagcaattgtatattgctaagtttaccctatggtcctcatgataccttaccatcctgtctcaaagtggaattaaactctattctgaggcaatagggaagaaaatacacacacacaaaatatatacagtcgtcccgaggtacctgtaggggattcgttccaggacccctatgaataccaaaatccacagatgctcaggtcccttatataaaatggcatagtatttgcatataacctatgtatatcctcccatatactttatctctagattaattataatacctaatacaatgtaaaagcttagtaaatagttgttacattgtattgtttagagattttttaaaagtctatacatgttcagtacaaacaaatgtaaccatttattgtttttgaatattttcagtcctcgggtggtagaatacacagatgtgaaatccacagatacggagggccgattgtatatgtacatggtattattttatcctatcctttgtgaatcacaaatatttgatcactgctgcctgaattaaagttttaaaaattcaaatggtctctttataagactttcttgaaagaaatcattgagaagaaacttgtagattcagaaaggtgtgcagagacctgaaaggcattattttgcttgactatgtatttaaaatttgaaagaatggctggtgggctaggattttcctttttttttaatctgatgggcaacttctacctacacaatacagactgtaatctaattaaatcattacagcctttttcaactggtttcaacaactatttactactgataaaataccttgtagcttttcagaatgctcttattgttgaaaaatgagtaatcagatataaaagaacacaaaatacagccactgggcttgagaaattgaaacactattggggagggaagacttatgcccaaagtaggtttatttttacatttttaacgttttagagacagggtctttctctgtcattcaggctggagtgtagtggtgtgatcacggctcactgtagcctccaactctgggctcaagcaatcctcctgcttcagcttccagagtaactgggaccataggcgtgtgccatcatgcctggaatttttttttatttttatttttttgtagagacaaggtttcactatgttgcccaggctggtgttgaactcctgggctcaagcgattctcctgcctcagcctcccaaagttctgggattacaaacgtaagccactgtacatggtattactttatcctatcctttgtgaatccggcccaaagaatatgaaataatacacaaacagcatgcaattatgaaggagtggtaaaaaaaaaaaaaatagggaatgtcggagatcagataattttattaaaagttaaattagagtagtcctccatgagatttgagttgatcctttaagaataatcaagagttggtagaggaagagctggaaggactgaggattcacttacataaactgtattgtttgactttgtataagaacatatacagtcattcctcaatatctacaggggattggtttcaagaccctcctacagataccaaaaatccatggatgctcaactctctgatataaaatggtataatatttgcatataacctacccatatcctgcaatactttaaatcatctctaggttacttataataatacaataattattaataattaataatacaataaatagtcgttatacttttttatttgtgtttttatcttttttaattgtttttttttcaaatatttttgatttacgattggttgaatcctcagatgcagaacccacaaatatggagggccaactgcattgtccatataactacagaaaaggcttaaaatttagaataacggggtaaagatagaggcattcaaggaataacaatagtgatggaaagaggaaccactatcctttgtccagggcttcctaggggacaagcattatggagttattactgaattattacctctgttttactgatgaggaattgaggcttgaaaagttagttttgttttttttcccttaagttcgcacaattctaaaatggcaacgccaggacacaagttgaaatcagactctaaacctgtctcagatctgctgaatcttataaatggtggctcatgatgtaatcccagtacttttggaggcctaggcgggcagatcacctgatgtcaggagttcgagatcagcctggccaacctggcgaaaccccgtctctactaaaaatacaaaaattagccgggcgtggtggcgcatgcctgtaatcccagctactcgggagcctgaggcaggagaattgcttgaatgcaggaggtggaggttgcagtgagccgagatcacgccactggactccagcctgggctatgcagcgagactctatctaaaaaaaaaaaaagaaataaaaaaaatatatatatatatgtatacacacacacatatatatacgtatgaaccctgagtggctttgtgcacaaccatgtttgagatatctttgttttagaaaccaatttaaatctacaattctgactgattagcgatcctagaaagaggaatggataacagatcaaaaagttttattattgactaacacatggtgatcatttttatatgtatccacgctttggcatgaataactaaatatgaatattaactcgttttggtctcttaagaaatttgaaatgttgaactcatagaccaagactataaatttacatttttagccagggtaagtaaataatcacatttcaagtgatgaaatgattttagggatcatcagagattcattcatttatgttaacacttaggtacagagaaactattgagtattggataattcaatattgctgtaagtaaataaaatgattccatatggatttccatatttcaactttgtatttttacttctttatttatattagagtggaaactagctcatcctcaatcatagtcaccacttcaaagggaacttctttgctcagtccagggagcctgtgtgtcaaaagtgaaggcaaaaatacttgctctctccatactcaaactctctctctttctttctcgctaattttttaagggtggtatgtttggaccatagttgtttctgctttaatcataggtgacgattagtcaagggcaaaatggggtccctgggtctgagctccaaaacgtagtcatctgactacagttatgcttttgaattttccatggcctcatgttctgcattgttaaagatggttcctatttacccagctgctcccacccactaaatgctaggctagacacttggacctatattatctcatttaatcctcccaagatccctaatgagcaggtattatcattcccatatttttgcaggagatacgtggttgttccaaggatcaaataatacttgaaagtgctttgcaaactgtcaatctggagatttacaaatgctagttattattcttggtaatagctagctcttggtgtttgatcaacaaacacccttgaaccacatctcaaaacaacttaaagcagcatcttgacagattactccaccttcctgtactaccactcagccctgacctacgaggcagttttctagaggtatggaagcagccctatggccttgcctaatatgttatcagatgaacgttttattgatacataatatttgtacatatttatggggtacatgtgatattttgttacatgcatagaatctgtaatgatcaagtcagggtatttagaatgaaagagctactggaaccagttaacaagctggacactataaataagtgaggcccttgtttgctgggaccctctagagcttaaatcagcaatccagaggcaaaaatagcatctccctccaagctccttaagtgaagtgcatacggcttccccatgtctcctagatctttcagactcactcacacaggccatactcagtgtgtgagtctaaaagcctgcccatttcactcttcttggctttgaatctgaccatgtcaaccaagagtgactgagctctaaacagctgtgtcaagggtcaaagaagggggaaataaacactctaccaggtcaggatattcatcctaacacctaagttggtaaaaattccataacagataaagcaaacccaccagctggcttggttaacacaatagcacttccgcaagtttgctcccataatatcttcctagggatggatcctttcagagtggaaatgacataaactgcttgtgagcctggatatttatctgacctattagccctgttcaggaaggaaatggagacctctgaggaaagcacgtgagaagggctagcagtccagcccgcgaacagtagacctttcataagaaagcatccagccggcttttttcatggattggagtcttcatattttgcccttacttgcaattccaaatgactgaacagtggaatttgcaattccaaatgactgaatgtcactgttctctgtaaatgttgctttttattgaaatgtatttttacttcagcttttggaattaggcaatttccagatatcaacaccgaagtcagtggttttttattattattcacattaaaaattatctcattgattgagctccatggagctcttttcatatcctgtctatatattcttattacatgttataatgagctctagaccatggaagcaacgacttatctttgtttttcatttctgcattcccagaatttactcagtgtttatctcatagtagctacataaaatattccctgagtaaacaaataaggttttttctttcttttttttttaaaagcaggatctgataaagcagatagggaaaagaatatttataaaggcacaaaaggaatagaagctgctcatgatttccatattgtttcagtaataagaacctagtctatcccaatgtaaataaaaataaaaaccatattttccggattttccccctcaataaatagcaaaagagatataagggaggaggcagacgatgataccgctattctaggcaccctgcacaactggcacagaagagagcacagagaacaaaacaccccagggcccctacagtggaggagttggaagctgccttcttgtacagctccttcacttcagcgctttcctcctcctccagccccagtcgataccgaagttccttcctcttcctattctaagagagacagctgctaacacacagcccagggccaacttgcttcatcatttactcacataccaaaggcaaccctacaaaaaaaaaaaaagaaagctagccccctgagctcgtctgactagtctaggcttactgtgtatcatgtcacccatcttttcctcatctgtctagatgtgtataaatgtgacagccatagtataaaccaatgccagcttttcttttcttggaaacagctgtaggtgctctgatggcacctgtggtgctgatccaatcagattaaccagaaacatgaaagagccgctcccctccacccctgccacccgcatccccagacttcaaattgggccttgtttttaaagccatttctttcaattcaccactcactgcttcttaaaagtccatttcactacttagcttggtttagaaaggacaaatcaaagtttccacccaattataattcccttgagagttgttcaaagtttcccatgtcagccagaaacacatatcaaccctataaccactgagtaatttatgatactgtcaagaaatccaccattggattacaccaatgaaggttttattgtaacagtaaatgcccagataaaataatacctcgtgtacatccaacacttactatgtgccagtcaccatgctcggcactttacaagcattttcctttttgatgcgacatgcaaaatgtgttttcctttgtcagcttaaagtccatacctcatgggtacgcaacaacgttgtgtcatacccaaaagtccagaatataaagtgattaagttttaaatggatttttacaattgcatttgtatcagatttttccagaatgtttatgccacatactgaaaataaattaaatctttagccacattcagtttctcagactactcatgcccactttatggcaatgtcaaaaaatttaccagtctaagaataatctatatattaagacattcaggaaaacaataatcctaagaagggaattagtgagcccattaagttgcaaccacaattcctttgtttcctcattgacatcactgtcctaactctgctttcttttgcagtgtccccgaggttgtctgggtccatgtacatgaacacagctccaggcatgaagtctggcccttcaagatggccaaatctacactggctcagctatagaaaatgtcagcatgggggcatcttctaggcaacttattttggtggccctggaggcatcattgcaaagccacatctctgcaataattcccagacagcatggtaaggcatcatcctacacccatgatgctggtttattgccaggccaagcaggcgtttaaaaattaccgtaaaatcattgtgtttactcctgaaaacctcagaagagacctcagaaatttcagaaccactcaaaaggcaatcctgcctgtgctggctggcactgttaaccgctgtaggaagtagcaggaaagacacaaaactggacagctgggaactgtgctctagtcctagttcagagtcactaacccactaggtcattgcggaaaacttcttttactactctcagccctactttcctcatctgcagaatgaggatggaatgacatgagctccaaggttgcttctggctctaaaacattattttggtttatagtgggcattcggaggtttgaacagcattctccttattgtgaatcaaaaagccagaagaaataaccatgcattgtccccactgtgtcttactgcactagaaaagcaggaaaagaatcacatttgtgtctgtacctaagagccaatcagcaacgacatctcctatttcttcctagttttaaggggcaggaccttgaatctcacaattttacatgtttctgttgacagggtggtggtttttgacctgtgatactacttctttctgccaattaaaagagagaccacaaaatctaaagtaatgtgaatgtctcttcccccttttatttcttccatgaacacagtaaccctatccattcttatattctcacatgaaatttatttcagaaaatatacattaacctctctctcttaaaaaaaaaaaaaaaacacttcactattactctatagaaaatggtaaaaatggcctaaacccttaaccttgcatttaaagactttcaagaccttccctccaggtgactcttccaacatcctctttcctggctccccatttggcaccctgtgctctagttaggattgtctaaaattccaaagctgtcttgcctattcctaccgacaggtctctgctggtctcactcctgcagagcacctcactcttctttgatgcataatccacagatctgtcaaagcagcttaaatcccaccaccctgaagcaaggtttattgtctactcaaaagcagattcatctcttcctcctccgaatcccaaaacactcgtctaatgcatcaattctgcacatgtccatcaacaagtgtttattaattgtcacgtctctgccctttggcaggtgctttagaaacaaaactacaaaacacattaaagcaacaatatatactcttatctcacatacacataatacaagacagtggttaaaaaatatttggcagtcagtctacatccaatgtccatacacttaaccattacacattctgcctcctagtttctaacagtcgttctgacatgtgttgcaggctttctgtaggccaggcacaatgctaaggcacatgaaacactttattttgctctcccaattttctgtgaaagtaagtactatacattagccctgttttatagacgagtaaaatatagcacaagaacgttaacaaggtgcccaagaattacgtttacacagccacatgatgaagaggtaccatgtgtacttgtttgtgcatttttcgaactctctgagcttaccaagaatgattccaacaataataaatcactaggcaataatacattgctctctgcaggtgaaggagttgagagaggactcatccagaaaatagacaggtgaggaggaggaaaaggaagctgccttgagtttcccattaagaacatatgcctggagatgctttcttttattccatctatcataaatatccttgtaccaaactaacaaaattaaaatatagttttaatacattttacaaatatttggaaatcttattttaatcacatggaaactattaaaaaatatacatttcaacacattgtatacacgtttggaaatatcagactatatctcataaatatgtgcaattattaagtgtccaactaaagataaaaggaaaaaaatacatatctatattgcagactaaacaaatgctgccataaaattagtacaaacagaattgcatattggagtcagttggaactggtgaaactccataaaattacaacattttagaagacatgtgtctgagttattcacataccacatggtgaaacatcatatagtctgtctgtattttagattaaaatcaactgggaattactgtgaacaagtttgaaaaactatatagggttacacaaagaacatcatacgtggtaaaaagttaaaaaggaataactgataacagggattttacagacatctagtaaattcaatattgttttctaatacaaggcttggaaatggtaggtgcagtgatcccttttctgggaagcctttctccatctctcaggactggggtcagtacctttgctttgggcacaatgtgcttcctgccaccatcaacagagaaagtatttagtagctgttggaatgccctactagactataagctccatgaaggcagggactgttactgttcatattaccttaattaattaaacacatattaattttttatgacctctcaaaaaacctatattaactttcattgtgggtttttttttttttcttttgagacagggtcttgctctgtcacccaggttggagcatagtggtgtaatcactgctcactgcagccctgatctcccaggctcaatgatcctctcacctcagcctccagagtaactggaaccacaggtacatgccaccatacccagttgaatttttatttttatttttagtagagacagggtcttgctatgttgtccaagctggtctcaaacgaccaagctcaagcaatgctcctttttggcctcccaaagtgctgggattacaggtgtgagcccccatgcccagccatatcgttcttaataacataggttcaaaaggcctaaagcaagcaaaatgacagaactatgaagaggacttgaaaatttcactctcggcaaaaaaaagctagaagcattccctttgaaaactggcacaagacaaggatgccctctctcaccactcctattcaacacagtattggaaattctggccagggcaatcaggcaagagaaagaaatgatgggtattcgaataggagagaggaagtcaaatagtttctatttgcatatgacatgactgtatatttagaaaaccccatcatctcggccccaaagctccttaagctgataagcaacttcagcaaagtctcaggatacaaaatcaatgtacaaaaatcatgagcattcctatataccaataatcgacaagcagagagccaaatcatgagtgaactcccattcacaattgctacaaagagaataaaatacctaggaatacaacttacaagggacgtgaaggacctcttcaaggagaactacaaacaactgctcaaggaaataagagaggacacaaacaaatggaaaaaaaatccatgctcatggatagaagaatcagtatcgtgaaaatggccatactgcccaaagtaatttatagattcaatgctatccccatcaagctaccattgactttcttcacagaattagaaaagctactttaaatttaacgtggaaccaaaaaagagcccatatagccaagacaatcctaagcaaatcgaacaaagctggaggcatcacactacctgacttcaaactatacgaggctacagtaaccaaaaacagcagggtactggtaccaaaacagatatatagaccaatggaacagaacagagaccttggaaataacaccacacatctacaaccatctgatctttgacaaacctgacaaaaacaagcaatggagaaaggattccctatttaataaatggtgttgggaaaactggctagccatatgcagaaaacagaaactgaaccccttcattacatcttatacaaaaattaactcacgatggattaaagacttaaatgtaaaaccccaaaccataaaaaccctagaagaaaacctaggcaataccattcaggacataggcatgggcaaggatctcatgactaaaacaccaaaagcaatggcaacaaaagccaaaattgacaaatgggatctaattaaactaaagagcttctgcacagcaaaagaaactaccatcagagtgaacagacaacctacagaatgggagaaaaattttacaatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacaaacatatgaagaaaaaaagctcatcatcactggtcattaggaaaatgcaaatcaaaaccacaatgagataccatctcaagccagttagaatggcgattattaaaaagtcaggaaacaacagatgctggcgaggctgtggagaaataggaatgtttttacactgttggtggttgtaaattagttcaaccattgtggaagacagtgtggcaattcctcaaaaatctagaaccagaaataccatttgatccagcaatcccattaccgggtagatacccaaaggattatagagcattctgctataaagacacatgcacacatatgtttattgcagtactatttacaatagcaaagacttggaaccaacccaaatgcccaccaatgatagactggataaagaaaatgtggcacatatacaccatgtaatactatgcaggcctgaaaaagaatgaattcatgtcctttgcaaggacacggacgaagctggaacccatcattctcagcaaagtaacacagaaacagaaaaccaaacaccgcatgatctctctcataagtggaagttgaacaatgagaacacatggacacagggaggggaacatcacacactggggcctgtcagggttgtggggcgagcgggggagagcattaggacaaatacctaatgcatgtggggtgtaaaacctagatgatgggttgataggtgcagcaaaccatcatggcacatgtatacttatgtaataaatctgcacatgtgtcccagaacttaaagtaaaaaaaaaaaaaaaaaaaagaaaatttcactctctgagtggaaggcctaagtgcacctctcctagtcattaattgattacacagactgaaaacattaatgagctcatggaaattttgaagatacaataaacttattctaatatttcttaaagcatactgcatccataagtgagaccatatgcaattgtcttgagccctgatcttaagggatttaaactagaaaccaataaacagaaagacacattttaaaaaatacacatatttgtaacttcaaaaaaaaaccccttcaagataagactcttcccacaaaaaatataccaagtccaaagttgacttgtatccatctaccaaacattcaaggaacaggtaaaatattttgagtgatgggaatatagttattattgctatgtttgttgtcatctcttgcctgcagaatgaaatatccctaatgaaaatactggtcacttgaatttgtctccaacttagattcaggaagattataatattaaataaataaataaatgcatgtatgtatatgtatatgcaagtatgtgtgtgcatcacacaccatagcactagaacctgcactatgcctgctactggttttcaaagaagaaacaagttatagaaattataataaaaagaagtctagctcagtatacacttacaactttcctagttgcaaactgggaaagatttttcaaacatagaaccttacaatctataaattaaacccaagaatgaaatctcatgtcttcacttccagataaaaagtgctacatagaaatgctgagctttaatttgaacttttaaatcaaactattaaaaaattacaatgggatgatccgttgaaacatgcattatacaaacaaacttcctcagccagcctttagaataagaatagcaaaacaatagtttggaacttcagcttcagctaatttgaaggggctatgctgaaactgaaaggcaaggaaaggtcagtttttttcaatttgtatatttttataggtataattagagaaaagaaacaagagctccaaccttgtatgttggaacagaaaaagaggactactgcattttaattccttgaaaactctggaatgcattaattatattaaattctcttatatgttatgtggttcacaaatcaaatttttcctccaagtttgaaggactgagaggcttcttaaaattcaattaaaacgatgtaaagaaatatccacattatggatacgctccacttagagacctttgcacttggcaggaaaacttttctctttttatcttagtagagttcaggaaatgctaccttaattttctctttgcttcaatatttcatgagtgcctctcaatgcatagtctccgaaagcgttagattactgacatgatgctattttacatgatgtggatgattttatttgtacgagttcaacatgttagaatttttatctctttttcttttacacttagaaaaagattgtaatgtacaaaatgatattctgattttttgtataaacaaacatctcttatactgagatctaatgagtaaaatatgtcccccaaagtttagtattattgcaagaaattattcttcataataattgcagaattcccttcttcaggtaataaacttttactaacagaaggacaaaaatgtttccaaagacaccagggtccttacatatgcaaattaataaagcaaatctattgtcttatcaatgaaagcatcctcaaattcctccatgctttatctgtgttctcacatcatcacaaatccacatctatatgagatcctagagctacagaaaaatgcatgttcagagcacatttcagaccaaagtagtaattaacagaaatatacttccttggttttggtcctcttggtatgctattacttccttcaaaaaaatcaacatttatattgtgcttaggttttaaataaaacaaggatgtacatatgttcataagtatgcgataactgaaatatcagacatccaaatgtcataattattatttttaaaattctaacgtaagtggcatgttttaaaacaaacatgctatgtcgataagttatttgttcaaatgctcataagtacatcttattgaacggctgtaaatgtgtttcggtgcattggatgctgtttatatgcttatatttctgtaactaggaaataaaaagaaaccacatcattaattgtcaggccctccatgtgacagtagaacaaccgataggccactggctcaattaaagtgtgcagggctcgtaactgaagagttttgtttttatcacaaagagggctagagcatgacaggaattcttcataaatttggagatgttatgtaaatatttaataactctgctgtgacaggccatgagtacttgagcagaacctgaccacaagatttaaataaatatcaagcctgggagttgttaaatattgaacatcattatgattgtggtgttttaacaaacaatcattaaaaggtagtgcaaatccaatcaaaggaacatttttaataaagaaacaaagatctggcatgtttacattttggaaaacaaaaatcaaacatctctgttcagttatcctaaatattctcccttcagctccaccaccaaccaaaaaaggggtaaaaaaaaaaaaaaaaaaaaagattaccttggtttgtaaaaattaatagccttcgcaatttcttcagaatttgctctagaggcacagctcatacatgcattgcctttgctatgattaactttggtggtacttttctcctgtgctgccatgcactgttctggaaagcctgtcagcggctgtcttctgttgtctgtgtcacctgagtccttgtgcttgacttcctctacatggtttaaagatggatttgcaccagtaattctttggatacttgaagtgaaacatgctgcccaggtgatgcttttgttgcccaagtgacattgagaagcaggaattgacttcagcatgtcggcttccctcaacatgtcaagaaatagcaaagccaaatcccagatgtggtccgttaatcccactgtcacagaataaactatgtggtcccagtaaacacaaccacccattagcgctaaggagaggtgatagaaaccatttgttaaaggtgacactgttttctaagtgataacactcttttgatcatgtgattcattttgtttgctcaacaacatggtatgtgtttttcctgagaggaaggacttcaatatatatttacttagagcttttaatttatacttcctttcttttaattggtgtcttgtgatctaaaattagctgatgaacatagtatctcactcaaactctctcagctgagttttcaataattagacccactgttgcctgaaattgaacaaacatgtggagacttggcttattatttcttccctagtgctttctatccatacttagagagtgattttttttttttttttttttgagagagagtctcgctctttcacccaggctggagcgcagtggcgcgatcttgggtcactgcaacatccaccccccagggtcaagtgattctcctgcctcagcctcccgagtagctgggattacaggcacccaccaccacacccggctaatttttttatttttagtagagatggggttccaccatgttggccaggatggttttgaactgctgacctcaagtgattcactctcctcggcctcccaaagtgctgggattacaggcatgagccaccacgccctgcctagaaagtgatccttttatttcacatatagtcatattaatcattatcccccaagctggagttaggttaataatttcatgtaaaaaatgaagttcaaatagtcttgactgtaaccttactgaataaagagcctacacgaaaaggaattctttcgtgaaacctgagattgtcagagcactgaatttcaccaataagctggatatcgtttatacaaggaataaaaggtcacgtgtcctctaaaatcccacatttgctacagacattcttccctctattcttttgtttgtgcagtaactagatacaggtacaatgagagtgaattagttttcccagatgagtgagaaaagtaagtgttccccaaatgcccaaagccagattttatctgtcattctctctctctctccctctctctccctctctctccctctctctctctctctctctctctctctccctctctctcagagagaggcagcactctctttggaagaactgtaaggattgaaaatgatccagaaaaactgcatggattgaaaatgatccagatttttagaatttgccctcaccttgacaacgctaaaattacaagcagcagtcaacttttacaagatacccttattgtgtaacatttataggttgccaaaaacatgctaaaactaatcagataacaaaggtgaggagaaaaccttcacctgccatgtagctagcagtgaatacactttttatttccatgacattttctggcagaaaggggttggcttaaggcggatcggactaaccttcaatttgtcatagcgctcactcaaagctgccacctgatgatcgcggtgccgcccaaccagtttacacaaggcacagattaactggtcatcggtcacacagtacatattcaccttctcatcctcatgctccaagcacatcagcccccggatgtgagagtccggaattggctcaatcagacgatggcctgtaaagggcttcttattcgggtgagtggctttcaggcactcgtcacagtaggatacttcacaagtgacacaggtcttcacagcgtcctgggcaggatcctggtcacaaaactggcagaggaccttctcggcggaggtcatggtgttggcgtcaaaggcccgctcccgacgggtctcgctgggagagttgggcccgctcactgatgctttctggaacctgtcgatgatgttctgtagggtgacgttgcgcttgagcccgtctagacctcgctggctgagggtgatgacatgccggcaggtggggcactggaaggcggtgatggactccacagactcgttggtggcacagtgtgatactaggatgcggtgggcgcagttgaagcagaggctgtgtgcgcagggcagtagaagagggtcctcaaagagctccagacaaatagggcaggtcagttctgactccagtgtttccatcttcaggcaaagctctcttgtgtcatcagcaaaacccaaggaagctgatcagctatctggaaacaagaatgtaagatttgattaggcacagggaggtcaaccataggggggtgtcagctttgaatgcatctcagaataattccaaacacaggtcatgaaagggtaagtgtgtgtacattccaaataattctctttctattcactggggaaaaaaggaggaaaaagcatcctgagccatcatataccagttaacattttctcaaagttcagtaactgaaaatgtgcaattttttttttcaattttgttttttaaaaggcttcattcaaaactagaatgtaattgaaactgtaatttccataatttgtatttaatcagaataatcttattgtgtcagagtcaggtttaacctcgcacagaaaattaaaatgtagaaatattcatcaataaactagagtcttttataaatttgaatttataaacttacgtattaatgtatacgagatttaaggacttttactctgcaataccaaaccaggtttcagaacaataggaaggcagtaactatagaaatgggcatgaaatgtacatgaaatcaaatgtggggatttcagcagagatgatcgtgtttaagtgtgggatgtcattttccaaaatatattcctgagaaaaaacattgactttcacaaagatgattgtgatagaggcaatatttttggcatgtgttcattatgtttctgaataattctattgtttaatccagcagtgggacgtgggtaggcagaacgaagtggagaaaaatatctgggggctttttcagtggctgcagtaagtttgagtaccaatgactaatatttagagcaatgatttagttaattagaacaaggatttcagtggtcatcatattcatgtgataagttatgttatgacaatgataatgattacagttgagaaagcaatttaaggaggcttacaaaactgctgagggacccttttggccaaaaaactcccaccacgggcttgtcactgttgccagcaacaggccaggctggcaggaggtccagcctcacactcagagctatgttggcctgggtacgacctctgctagctatgttgctctcctccaggccacccgagggtggcccagctgcctgctccccttgccataaagacctgagtgcttttgtgaactctcatctgccttcccatcaaaaagagtagtagaaagaattccacacaaaccccagttcattaagggtgaagaggcctcatgctcattagcaggcctgggaaccaagccgctttgaaccttctccctttcaagaccattagcagaggtctgcagaccagtgatgggaatattacatgcagcccattgcaggctgtgggagaacagtgcagttcacccagtggtcgggaggttcaaatcacccacgggggtggtggggagagcgttctcagccggatttatgggaaggcttcacatccaaagctatgtttagtgattctgacaatcaatcgtttgtattcacacctccgcttatttacaaaattcacggtttctagaataccctgaccccttctgaaatagcatccctcagaaataccaatatggtgctttggtgaaattaatgctcatcttgctaccaactgaatggtaactgatcattaaaagtataaagtatgtcccgagcctgttaaaaattaaacagctactggcttcataaaagcctggtatcttaaaaaatcttcaaccattcactagcatttattatataggaaagaataaaagagcaactgtgacttgaaatattaaagcttgtacatctttctacaacctgcaatggaaaccctagggttgctgttgtaagaaacatatcatccccacttggtctgtcacctcttcctacagatggctcagaagaaatggaaaggtttttacctattaataattattttggttaatcatagaaaaaatgtagaattatctttaaatcaaagttcttttaccttctcatcagaagcatataaattaaaggaaaaatgtagcccttttggtctgctctgttctcagataaaacaagaatgcctaccaatgaatctgaatagaaggatgagcatcaaattatgtctggagagctatgatgactatatttttaatgcaggtgccaggattccatcccagagaggtgtgatgagaatttctagaaaggattccactggggagacctcagtggaaatactgacattttattcattccttcaacagatgtttactgtgtgccaggcactgagttagatgaagaagccagaatctggggttcacatcacctcatctctattatcatgggccaagccagcatcatctcttatgtggactatcataagacctttctaaatggtctcttggcttctgttcactcctgcccttccccctatagtctatcctccactcagaagcaagagagcctgttgttaaaacatgacagaacatgcatctccttttgctctgccctgtaagggcttcccatttcacccagagagaaattcaccagaataaaccagccccagaaaacacagactcagacagtgagctcacttcctcccacgctacccactcctttctctgctctgagcacatggcctcgttctgactcctcaaacatgccaagcacatcaatcccctgctcgcccctgcaaggtcttcagaatccacatgactctctgctccagtgtcactttctctctgaacccacataaaaccaattccccttctaccactataccacctacccatcgtggtaattcttcccccatctcggtttatttttctttataatatttatcactgacatattcttttagtttgtttattgctccttctgtccccactgtcctcaacactagaatataagctctgtgaaagcagagattttgctttgctctttgaagaacgtaccaccaacacctagaacagcactcagcacacaaaatgactcaaacattcattgattccattaaatgtactgacttttcagctaaaaccaaaaagaatcaaacacagcccttgactttaaggatctctcaatatatttgaacagaggtcaacaaactttttctataaagggtaaaatagtagacatttttggctttgtgggccaaaggggccctgttgcaactactcaatctaccactgtagtgcaaaagcaatcagacacaatacataaaggaatgagtatggctgtgttccaacataaccatatttagaaaaacaggtcacaggccagcattggcctgcacatcttattttgttgagccatgtattggaagatagaggcatatacagataaccagaacataaatgaaaatcattctcagagaggtatgaataaaatgctgtgtgggcaacagcagcaaggatggcggagcaagacttgaacaagcacttacaagtttccagtgctaatgggaaatgatatgcaatgggctttgaatctgacatcaatggaaattatgtgactcgagtgcttaggggcaactcatgtaagaacgaattaatagtagctgctcaaaactagatattttcttttactgccatagcacctggcatagtgctttatgcaagtgtctgtactgtaaatggttaattgtattaggtgaagacacaatactcagatgtggtaggtgaatttcagccaattttctaaatcttttgcctgtatgctaccaaaaaggaaggggttttggtttgatatctatagtgcatcccactttttccacttttacccagattttacaatggcatagatagcatttttgttaaatgactctacagtatcttatttgtactcattccattccttcttctaaaagaaacttagtatggtttattttctagctttctttaaaatatctttttggagaaattaaaatgccattcattccttttttttttttttttgccattcattctttcaccaaatacttaagttcatctatgtacttggtcctgagacaagtactggtaacagctggcccctgtctccatgatcttatggttcattccgagagagaaaatatgaacaaggccaggtgtggtggctcatgcctgtaatcccagcactttgggaggctgaagtgggataatcacttgatcccaggagtttgagaccagcctgggcaacatagtgagaccctatctctaccaaaaaataaaaataaaaaaattagccaggagtggtggcacatgcctgtggtcccagatacttgggaggctgaggctgcaatgaaccgtgatcatgccaatgcactacagcctgggcaacagagtgagcccatatcgagaaaaaaaaatgaacaaggtgtaatgcaacataaaaaaagatgcatgccaaagacagacagggaataatcaactctatatagggggagaggagacagggagaagcttcctgaaggaggtaaagtatgaagtgggttttaaaagatgaacagggattcaccaagcagatagtggtacatgggtgggaattttatgcaaaatgttatctttcttttcactctctctctctctctctctctctttctctctccctttctctctctctttctctctctctctctatatatatatgtatctaatacacacacacacacacacacacacacacacacatatatatatagcttacattgttatttatatcattaataacagtatcaggccgggcatggtggctcacacctgtaatcccagcactttgggaggccaaggtgggtgaatcgcttgaggtcaggagttcgagaccagcctggctaacgtggtgaaaccccgtctctactaaaaatacaaaaaattagctgggtgtggtggcgtgcgcctgtgattccatctactcgggaggctgaggcaggagaatcacttgaacccaggaggcagaggttgcagtgagctgaaatcatgccactgcactccagcctgggcaacagagcaagactctgtctcaaaacaaacaaacaacaacaacaaaaaccccaatatcataaaacagcagcttttgccttttcttaactgtcataatgtaatttccatgcctcaaaaaaaaaaaaaaacttcttcatttctacttcaataaaaggaaatcacacatgcatattgttgtcaggaaatcctatagcttaacatttttgtgaatgggcagattggtcctcattgagaagaggatctagataatcttgagagtcccttgcaacaaactgggaatggcaacaaatcacagctcacacctctgcctgtccatggtttaaacatctagaacacagcacagaataatgaatgaaaggggagagagctggacaggtgacgggataatctaagacatcctgcagttctgctacttattagctgtctgagtatccatgggtgagtgtccacagatgttccctacagtccctctagcactcactctaatcactcccctaggcaggagagtcttcagtgacagattacagtgaagccccacatcgtgggaggcattggatacatcttttgaaaaaactttcttatagattcaagacttatgaggaaagtacttctttaaaatggaaaattaataagtagatgttttgctggaaaataatgatgtaaatgttttcacacctccctcttcttcctttcctttcctctctcataatatgtatcttagtccattttgtgttgctataacagaatacctgaggctgggcgatttataaacaaaagaggtttatttagctcgtggctccacaggctgggaagtacaagaagcatggtactggcatctgctcaagagaaggaactttgctttataacaactccattctcatgggaactaatccactcctgtgagaaccaatctagtctccatgagagcaagaactgactacctcaagaagggcatcaagcgatttgtgaaggatccatccccatgacccagacatctcccactaggcccctcctcccaatgccaccacattggggattacatttcaacatgagttttggtggggacaaacaaaccacatcactgtatgtcactgaaactgtactttcctagttttcctctgtctaaccactgctgacttctacctcttgctaatcaaagcctaagtgttttctgatggtctatggttcctttgacagggccatccagttttttgtttgtttcatgtactgcctctctgagaatgactgctaggcttgtatcccaagatggtcgagaacccctttctggaacccggtttagcactgacagttctttgcttcatgtactgcaagtgcctcagacttggaatgcacatgatgtgggatttatcctcttccctcattagcctgtctttgtcttctctacagggctcctggtgtctcctcacagggcttctgtcctcctggtcaccagacagcagacaccacagtttctactcctccctctttgggggaggcacaattatggtccccaaagatatccacagcctcctcctcagagcttgtgaatattttaggttatagagcaaaggggactgactgttgctgatataattaagattgctaagtagctgaccttgagatggggagagcagcatggatcatctaggtggacccaaaggaatcacaaggctctttaaacgtggaagtggcaggaagaagagtcagagtcagaatgatgagatatgacaaagactcgaccagccatgcctggccttgaagatggaggaaggggccacaagccaaggaatgcaggctagaagctggaaaaggcaaggaaatgaattctccccaagggcccccaaaaggaatacagccctaaagataccttactcttagcccagtgagacctgtgtcagacttttgactctagaaatgtaagataatgaatttgcattgtttaacaccatcaggtttgtgctaacttgttacagcatccattagaataaggagatcgcccatcatcagcacatcatccataatttttatcccaaatttcccttaatggaggcattgacctttttaatgataaggtaaacccacctctcaatgctttcctacaagtattctaggttatgtctgcatactccatgaaatacaattatttttctaatttggagtatatgaaaaagaacatgcaattctatcaattctatcaataattttacttccagcccctcactttgtacaactctaaagccttcactaccagggaaattagtgagtcattagaccaaggaataaacttgtatgccaacactgggtggcctgtgattaatcgttaataccacgtggctgtcagccactgcccagatgattcccaaggcacttcctctagttcttttccaaatatcctctggactatagagactaactttattgttaaatttaccaaaacataactgagatgacaaacacactgttaaaattgcacgatgttacagcaagccacacgaaaatggtttcagaacaggaagctcctataagtatttcaaacaacaaatagcattgaaaatgtacaaatgaattatttgagagtcctaaatttcagaaacgaaatcaagtcaatttacttgattgtccgctcctcttaacccctattcacctgggtaattagatttagttgactattgctgtttggatttttgctatgagattatctttattatagaactataggtgaaatattttttaaagactgcagagtgatgtttctatcttggaccagcagaaatacagactttcagaggactcaaaactactgaagtgtgaaacactggaaatcaacctgagtttgggaggcagattgcaacggggacccaactcagaagggacttgctctcatcttaaataagcataatttctcaactcaaaaacttgtctaacacaaactcaataaaaactggctgctacatccaagatgaattcatcatagggtattttgaataacataatacaagcactcagcatctgcatattcaattatgccatttagtatttgactttgagtgataaagaccaccgaataaagacactacccaaatgttactttactgattagcactctggccaatttgagaagcaggtgggttagcaaaggcacagtaaaacagggccatgaactgatggaaaaaggggagaaggggatccagttggatttaactgcattctgaaagactggaaattgatagcataatgtaggctgtttcagtacaaacgcaaagtggttcttaaaaacaacagtataaataatacatcaagtaagaacaggtgaaaaaaggtgatccagtaacattttataggtaaagaatgttactctgaattatcactgcatttagcctccaaatgtcagcacactcaaattcatttgctcaaccagtaacagacaactaagaatttctgccaagaaaattgtaggggaccagagggactgtttgaaaaaaaaaagtgacaagcagatgagcactgagatgctagcctcaagttttaaaataattaatacaatagatattttgaataacttgacatttcttctttaagaagtgctgaaattattattattattattatttttttacctcatatctgaagtgagaaccagggaagacttttaatttcgccaaacacccacctggtggaattcatgcaaatcaaattaaactgttaaccaaatcttttctgtactttcacatctgcctataacatgctcattcttagtaactggatctctaggacattctttaaaataatcacatactcgcctgaccatgcaacctgattaataatgaatgaacattcctgagaagaatcacttcgaagcatggcagatgtctgtggggatatgaaggctttaatgatcaaaattaaggggaaatggaagctgggtcacactgtctggttattttaattgaaacctagtcttccaaatttacttaacagaatacttaaacactccttctcgaggttcatttatacaagcagacaagcacaaagacaaatggcaatgcaaaagaacaacccagattcctggaggaacaaccaccctatcctgttctgtcctaatagtgcagaaaacccctcagcagtttcagaaatccaatttgttcaattgaaagactgataaacaggttaaaaacaggaactagtacattggtccttaatagttctttgagcacctctctagattctgacaaagagatcaccttgaatacccaccaatggactgcacactagttctttttgaagaaacatcgccgtaggcagaggatggggacccacgaaatgatagacaggccaccgagaccagacggtgggtggcaggcagtgctggagcggtcctgtgtgtctgtgagtgcgtcaacagtgaaacacaacaggaaaatcggtccaacaattccaggaaggccagctccacctcatccactccgccagggttgcccgagttgaagaatcaactgccttttccacggcccccgccacaacttccctatcctctggcctactcaatgttcaactgaacccaaatggaaaggtagctcaggtcagctcaacacccactgcctggtccaaaaaaatgaggacttggcaacgggatctgtactctcattccttacagggaccagcagcagcttggccgaatgagacactgtcctgtggcagaaggctgaatgctagctttcaatgccaccaataggagccgtcctgcccagctcctggggctgggaacaggcactagactcatttgcctttggggcctttcagtgtcgtactgagcacatgatcacattatgctctgcatgctggcttgttcatttaaaaaaataatatacacattattttgtgcctttatcttctgaattaatgtataatgtctggaagaagttttcttcaaagttatatcaggaagaacaatctccagtacagacacaaagaacagtcatttatttcttccaaaaatagtgacctaaatagcaatctatcatcctgataaacaatttaaaatatatgtatatacacacaggtttcacatacacacgtatgcatacattatgtacacacatatataaaaacatcgtgtgtgtatatatatatatatatttaatattacatacacggtatatatataatagcaaatctgtgatgggtgtccaaaatttcagtctccagaatggcaaagaaagggtgaactgagaatggaaagaagtaatcttttaaaatttgattgactaaaggaggaaggggaagtagtcttcctaaaagaaaaaaaaaaaaaaaaagtcctgcgctgcagttctttgaaggatattgcttatcaccatgcaagacaagaaactgcaagtaaagtaaatcatcaggaaagtgtttaaaaaaagaatcttgcacaattcaattcataatccagacatttggactccaccaaaggtgtttaaggaacattcatgataaaggggaagcagaggcaagaactgcttcctcgggctgcccagtctgcacgtctcaacatctactttattgccattgcaacacttcacagtaaatcaaagcatgcttcacatgttaggacataaaaatgcaaacatagattttttggcttatgtctctccaaattataacttcatttgtcttttaacaatgaataaaaggattactcaatttcacatatagatgacttccttaagaagttctcattgtcctcggaagagacacacatagatcatcaagtagaattctaaagaacttttcatcaagacatggcttttgttaaaacaacatttaaattgtcaaaattctacaggcctaacttttccctattttggcactgtagtggaaaattagcctgaacatctgaagttgaaacatcaggaaagaaatatttactccacccctcaagagaaaatgataaacaacaaaaaaaattacaatcttctaaagggcataatctgacaacttgcagatgaaatttcccactatctgaatgtctcagacatttcatgtcttttacagtttaagaaataaagcatttagttttaaaggcacacagaacctattttacattatattgaaaatgaccgatgttttccaggtctatgctgtactgggtatcatgcaagaatttggttctgaaggcaatgatagcagactggacagagaggaagagggtgagagatggccacacctagtctcctggcagaagtctaaatcaaccctcctggtgaacagaccaacagcgtgatggtagcagaaatggaagtcactaatttctgtgaaaccagtcacagatgaaaagcttttaacactgctgtccctgaatgctttctcaaatgtatttatagtttgataggtatttctatatatattcatataactatgtctgtataaagtcctatatatgtccataatggaattagtttttgtagttatatacaatgtgcatgtatacataagtacacatatacatatacaaaagcaccttttcagaattatttgagactggctagaattcactcttcacaaacccctcagtcatagcatcccttctgcattacagaaacattccttccttagtgcagaaacagaaacctgtagataatgtttatttaaaaacaactgcctgctcatatctgcaaaaggtcacctggaaatgagcaaaatgacgcaagtgatctattctctgaaagaccagtcaagtgggatttttgcagcaagtataatagattgtgccctggagaaaagcttgccgcttggggaaactttttctcactttatttatataatactctcctagaaggcagagaaagtacacaccctccccttcccaattattaccaaccaggagcaaaatagttattgatgatggccaatgcaacatttcacaactgttctctgaacactggaaagcttaagttcaaagacaagaacaaatactagtctcgtgactcatggaggtaatgacgatgttatagagtaactgattcccattgtgtgagcagattggaaattctctcaaatatgatgcctccttttctcaaagaaaatcgctttttccctcaacttcaaagtcagccacacacaaaaaccttttgctcacaataccctgaagctacctcctgatcttaaaaagtaaggaaaacgaacccttattcacaactcctggttaactattacgaataacatgctttaaacatttcccctgatcactgaagctctgcagtcaggggaagaagtcttttttttttttttttaaaggcaacagaaagaggagtgactcttttgttctgaatgttattgtaaagcaccacatgaaagaagaggaatgatgggaacatggcaatgaaaaggacaacagcgctgacaaatgaaaacaggatattaagaacagcgtcgggactgtgtgtctgtacagaacaaagccgggagccttctcggagaaattcaagcaaaaatactcttaacagatttacatgctaatggatgaactgtagtttctccaggtggcacagatctttaagtctgggacaataaaattaggttatcattaaaacacatacacacacacacacacacacacactgtaaagtgtcataaaattaaaactgccttcaaatcacattcaatcacatgcccccccccgccccgccctttcaaccagtgatctgcttctggaaatttctagatctatgtttttctctttgtaaaataagatactggttctgtcaaataactgagctaacttagtatatagtcccaaggaaagtgaattttttacaaaaagaaaaacaattttctctccattcacagcacactctaacttacactttaaatataacttttcaatagagctttcaagaactcccagggaaactaggcaatgggtactgtgctgagaaacaatgacagcaactaagtggctaacattaatatagtataccgcttttgccaagtcatggtggtaatatcttatacttttcttctgatgcaaattctgcaaaagctgctagtatgatggtacatttaataaaacatcatcatagcttattggacttatcacataagaattattattgtagtctctaaagaagttcaaaaaagtaaaaaaatatgtctgattttgcgctccattaaaaatttcagtctttttttttctcttttctatgttttgccactattctccttttccccacttcctgatcagtcctttctattgtcagatgagtgatgagctgatgtgctttcttctttaccaaagcatttcatccagctttccctctggcatgctttcagaaaactttgggctaagccctgagctcagtgtgcccaagtgttcttggtctagttttgggctgacactgtcaatgtggtgtcctgtaaaaaaaaaaaaaaaaaaaaaaaaacatgtagaggtcaggcgcagtggctcacgcctgtaatcccagcactgtgggaggccgaggcaggcggatcacctgaggtcaggagttcgagaccagcctggccaatgtagtgaaacctcatctctactaaaaatagaaaaattagctggtcatggtggcgggtgcctgtaatcccagctactcgggaggctgaggcaagagaatcacttgaacctgggaggcggaggttgcagtgaaccgagattgcgccactgcactccagcctgggtgatagagtaaaaaaactcagtcatataaaacaaaacaaaaacaaaaaacaaacaaacaaacaaacaaaaaacatgtagtaccttgaagccagataacctgagttcaaatcctggctctgccatttccttgcaaaggcagatcggagccagatactgtacatatcttatactcacagatgctcttcctatcttctatgcagtttccttatctgagagcaatcttaagggtcctttgaggattagtgaggtgaactttttaaaatgcctgacaaaattctcactcttatggaaggacagggtggtaggggatgggggattggggtccttcttcccttcttgtcctgaatcgcctcttcccactcttctttgaataaattcattatctgtgttttttactggaaacctcttcataccatttttgcaagcaagaaggatataaatccatttattcaataacatttatggagcatcttatgtgaacaaacagtatgtgaatgtgaaatgaactagcatttttattcttaacactaatgacttatcttcacattggcaatttcatctgtttcctacactatgacatacctctgttcattaccactgatctcccaccatgaacttggggcttcacttccgcttcccagtgaaggtcaccctgtcccatatgcactctttgtcagaatttttttattttgcaggaaataagggaccctggcatggatggagcatgtgaaactatcaagaacagtgaaatgtttcagatttttgctatttgccagtttcgtttcatgaatgctggcagaagacacctgaatcaaagataaaggctgtttttactcaaatggtatgtgtttcatgttctgttggttccccttgttctcgaagtcctacggagcatcctaggtccatgtttgcacactcaggagatttgcatcatacctaagcaactccaagcttaggaaatctgaatcttttataatggactgcaagttagcctgcccaacttttgccctggaggaagacattgtctttaatataatgaacaacaaacaaacctgccttctcccctggcgcgagatactacctctatctcccaagactgtttgctatacaaacatcctggggaatagtctggaataaaatcattcagtgctccagctcacaagaggtacaaaaaggtgatagatccatggaaaattatttcctaatagacacaattcttatctcctcctggggatatggccaatagttgttactagaaatcagatcatcactggactttctagcagttaccacagaggcagaatttcatttggcactgaatgacccttgagtcatagaagactagaggtaaaaggagcctgcaagaaagtgataagaacttccttaccaacggctccaagctccttatccaaccaccctctgacatcagctgttgtacaaggaaaattggcagaaagcaggtaagcctcacccatagattttgctcaaataaacagagcccttaatgtccttcatagtcccaaaacagcttgggtctggtctgcaacttcagctcttcactctgaacctaagctaattttaagagtttggtgcttgtttcagcagcacatagactaaaactggaatgatacaaagaagattagcatggccccaatgcaaggatgacaaattcatgaagcattctataattttttattattaaaaaatattaataaaataagagtttggaagagtaagctaattttgttacttttatgacactggaaatcctatatgtatatccatttggctttctttaagcattaaaaaaaattagaactacttcttttggagtaaaaccagatgagtcatttctttcattactctttcattccactggtattttttgaggtcattctgtgtgccaggagctgctctaggcagcagcaaattggtggtaaatatgagcataaaggcctgcccttggagagcttacattttaatgaaggaaataaaaaaataaaaggtttttaaaaacacaaacatttcaaagactcatacataaaatgaaagaaataaaaaggatgacatgatagaaggtagatgggtggtgcaaatctatgttagctaaggggatattactactcatatttgtgctggctttcttgatattttggctttttccctgccaataaacaagcaaagagtatctgaatttcagtataaaactttctggtgtttggtcagagggttgtgatctaatttttcaagttgttaaatgcttagtttcagattgcctcaaggatagagttctttttcaagggcatagaaatccaacttttactatttcttacaaaaaaatggaatgtgatgaattattgtaaagtagtgacatctttatttattttagcaataaaattttgaaagagaaaagccacgaacacttagtgagccaaaaaagcaggaaccatgatgttttagtccattttgtgctgctataacagaattcttgagactaagtaatttataaagaacagcgatttaggccaggtacggtggctcacgcctgtaaacccagaactttgggaggctgaggcgggtggatcacgacattaggagttcaagaccagcctggccaagatggtgaaaccccgtctctactaaaaatacaaaaattagctgggcacggtggcagacgcctgtaatcccagctactcgggaggctgaggcaggagaattgcttgaacccgggcggcagaggttgcggtgagcagagatcacaccactgcactccagcctgggcgacagactgagactccatctaaaaaaaaaaaaaagaagaacagagagcaggttaggggcctggtatctctgtttccaaaatggcaccttgaagcctgtgtcctctggaagggaggaatgctatgtcctcacatggcaaaagagcaggagaggaagaacccacttccacaaacccttttaatagcggcattaatccattcgtaagggctttaccattaagccccacatcccagtactgctgcattggggattaagtttccaacaaacgaattttgggagacacattcaaaccatagcatatggtattcagaattacctgaatatcttaagtgtttgattctacgatgttaactcaaagttgaaaataaccatggatgtacagttaagcttatagggatggacaggaaggaaatgaatagagacattggaagaggcattggttttgtcagtacttactcaccagcttttgcaccactggaagaggaaatttcaggaaggaaaggaaggaaatgagggaagagtgctgggggaaataaacacatgtgactacagctttatgaccggtgagcaccaaagatgagttaagactagatcccactggctgacagccaatgtcttttgaaatgtcataatgtcatttgacaatgacaataatatcaaaaagcatctcaaaataaataaattcactggctaggtaaaattgcaatagcagctgaatcatgattttttagagcccatcactttaagaaagggttagaaggaaaataatcgcagagaaaattgggtagcaggacgagccgcagacaaaactcctcagacaccaagttaaagacggaaggggtttattcggctgggggcatcggcaagactcctgtctcaagagccgagctccctgaatgagcaattcctgtcccttttaaaggctcataactctaaggtgggggggtccacgtgagagggtcatgatcaattgagcaagcagggggtacatgacaggggcttcatgcaccggtggttagagtgaaacagaacagactgggaagttttacaatgtcttcctataatctatagataacatcagttgctaggtcaggggtggaattttaactaccaggcttgggtcaggcaggcccaggcccggtttcaggtctggttccttggtttcacgtctggttgctaggcgccgggctacctgcctttagttttgcttctctttccttttctgagtataaaacaatataaaacaatatgagagggtctgtctctcttctctcatttcccccctttgagactctcactttttattagtgggagttctcactcttatttttgctacttatgtcttcctgtgcaatagattgataatgattcacatatttacacttgtgctgatacataacacgaagtgacactgagagactgggctatatgctcggctaattgcaaaaacaaatttcctgtttttcctggaatttctggtactgacacattcagttcatcatagaaggtttgaaatactggctcaggagagcgtttataaacttttcctcaaaccacgacatttacttgaagatccagtccagctccatcaatttttagggttacacgttcctcttttttctagtgaggattaagggggttggttattactagttctaaggggttacactgaccactggtacaggaagggccacttttcccttgctgaaggtggacaggattttttttttttatccaagtagcctaaatgacacaagaccagtatccacatttatttttacacagtcttaatttatgataaatgtacttattttctgccatatagcctctttcttaattaagagaaccacatcctatttttaacctattattattaatgacagcacaggcatcgaatttcaaggtgacttgtttgggcacttctttttttgttttgttttgttttggctaacactttacttgtatcgtttatgagcctccaccagtcttcagtccttaatcttattttaaaaactatggtcatgggaggctcagatgggtcataacacacatcaggttggtcatttcccgggctacataccttgtatagagtaacattatacaaacaagtttttttagagttccagtacacttataataactgtaaaataataggactgtagcaaccttttgtcccacttcagtgacttgatgtatatactgggaacagccctcagtctgaggaaggtcagttgaagtccttactgtacaagtccaaattttaaggaaaatgagtcctgcgatgagtttcctcatgtttcggccgtgcatggaccagttagcttctgggtgtgactgaagcagggcttgtcgtcttcttcagagtcactttgcaagggttggcgaagctgctcccatccacgtacagctctcggtctactgatgtttaaggatggtcttggaggttgggcccactagaataaactgagtctaatacctctacacagttatgtttaactgggctctctgataccaggagtaaggtggcggggtttagagtgttgcaaacttcaattgttatgtggggattttcacagagcaagctttggtatctagttagtctagcattcattagctaatgatgtcctttggtatttattaaagtcaccacagcatggggggactttatgtttaggttttgcctaagagttagcttatctgcttcttgtgctaacagggctgttgctgctagggcccttagacatgcaggccagcctttggaaaccccgtctagttgttttgagagataggccactggccttggccagggccttacagtctgggttaaaactctaactgccatgtttttctttttctgacacatagggtgtaaagggttttgttaggtcaggtagccccagggctggggctgacgtgagtttttcttttaactcatgaaaagcttgctgctgttggttgtaatagatgtagtttactaatctacatttttattaactgtcatctaccaaaatattgactcaaatcctgtaactatttgatttcaagctttacattgatctggtattcctcatgggactccaattgcgtctaaatggacatgagagttgaaagacctacaaggggcttctctcgctttacaatgtcttattttttctcctgctggttgatgaaatgccagggtgaaagggatagccaattggactaaagtataagtgccactccagttattcggcagagtgcccagtaaaggtccaccacaataccaccacacatccgcgtgaggatgaacaagggctgactgattgataagctcttgaaaattcttaagctcatcgcatcccttcaggtctccaaggaatgctaagtttcctccctgtcgtgagagacacgaagtgaacttagtgttgggagacggaggctggacagccctcgggggctgacccgcagggtgccggactttgggatatagcagagagagcttggcatgacttattactccaggctgtagaatcctggaaaagaactaccacacagtccatgccttgtcgactggaggaccaccttagtggaagggggacaatcagggcctctggcctgccatgtgcacaagcataacaattgcttttgtttaacgtgcacatggaatatttgatccattccaaccaggcatttgcatcttggtatgctgtcttaattgccaaagtttgttttaagtttttaacttttatgatcttctagtaaaatgaatgtttcctttagcacctatttttattagtttttagaccaaagaaagccaaataccattttacatttaacaatgctttctgtatgatttttatactagataagccaaattttacctttatattagtgttattgatgttaaacttaattttaataaaaccttgtagacatatttatctaatttttaatgtttgaccataagcaagattttatatactctttttaacctttcataatttttgttaaagagcaggttggtgctttaagaaaaacctgttgcatttttattttaatgtccagttcacagaaaaactggatgatacctttttaactttagctaatatgtttacacacagaattttctttacaattaacgtctcaaaactcgcttaaactttcaaaacaataatttttttaaccttttaatgtaggtaaaaatccacattcttatgcctccttataatccttttaccaaaggtatattttacttttcttatacaccttgaacataaactgtttcttcaatagtactgagtacttttaaattatacaacattttttgcataattttttttttcccgttagcaaagcagctgccgctacagattgaatgcatctgggccattcgcgggttactgggttaaggatttttgataggaaggcctcagtgctcttgggatatgcccttgtttacactgacaacaaagtagtattagagtgttacagggttactgagaatacctttaattattaattacaggtttttaatttaccttggcttttaaaggaatagggtatactgttgtttttttttttaactacttgtatatttctctctttctctttttctttctctctttgactttctgtctctctgtctctctctgactttccttttgcctctgtttcttcctctctttctgcctctctctttctgtctgctggtctttccttgcctctgccagccgcttatgctgctgttctcttaactactgtggggggaaggggatctaaaaccagctgtaactgtctctgtacggaaactggtctgggtgccttggcttacaggctaccttgtgccatacctttgaaacaagggacttgtctaggcttccttctgatggccaagccacctctaatgctggccagtctatttcacacaaagttttaagttctcctggtgtcatagtactccatagtcttccttaaatcctttcttgaaatttttcaacatagttcctagtagggtgggcttatttgtgcctgacccatgcttctttgagacaaaacaccatgctcacaccacacgcacaccacaaaacaaagaacaggtaaaaagggcacacacacacttttgcagtttacaccaaaccagaatcaaaaccaaaattagagtatccagaaatctaagccaggtcaaaaccaaaactaagcaatccaggcaatccaagtatcaagcaatccaagtcaagtcaaaaacaaaaaccaaagtgccggtactgccacaccgtgggtgatcaggccatgcttccactcaaatggagtaggcaagttcctactcaaatggagtaggcaagttcccaagaccagtcctgtgaagcaattcaaaccaagtcaaaaccaaaaccaacaccaaagtgctgataaaggcacgctgtgggtgatcaggccacgcttccactcaaatggagcgggcaagttcccaagaccagttccgtcaagcaattcaaaccaagtcaaaaccaaaaccaaagtgccgataaaggcatgccgtgggtgatcagaccacgcttccacacaaatggagtgggcaagttccaaagactagtcttaccaagttttagatgtctggactccaagtgccagttccttcccagtgttcagccactgcgttgatcctccacgggggcctgccacacacggctctggcgaggcgtcccacctgggcaaatgcctacccgggagcgctctcaggatccgcgtcgctccggctggttggagtcccccgcagggatgttccacagggcaggctaaagccacctaaggagctgcctcaaccgtctgttaatcacctcgcttcctggtcagggaaccaagaaatgtagcaagacaagccgcagacaaaactcctcagacaccgagataaagaagaaaggggtttatttggccagaggcatcagcaagactcctgtctcaagagccgagctccccgagtgagcaattcctgtcccttttaagggctcacaactctaaggggggtccacgtaagagggttgtgatcgattgagcaagcagggggtacgtgacaggggctgcatgcactggtggttagagtgaaacagaacagaccgggaagttttacaatgtctttctataatctatagataacatcagttgctaggtcaggggtggaattttaactaccaggcttaggtcaggcaggcccaggcctggtttcaggtctggttccttggtttcgcgtctggttcttaggcgccgggctacctgcctttagttttgcttctctttccttttctgagtataaaacaatatacaacaatatgagagggtctgtctctcttctctcagttgtaggagaataaagttgctattgtagctatagcagagaccaagagaagagcttgggaagtctgggtggtgggtgccctgtgccactcttccacagtgaagcaaataaggtttgtgggaagacagggtcgcagcattccaggggaggggttataaagcaagtagtcttctgagggtgagttattcccagcccaaagactttttggcctaaaagccaagatttaaactgtttatttggagacttgagaattctgcccaaaatatatgtaaaaaaaaatgtactctatataagaacaaatcccataaacgctaggaagcttctaatggcttttaaaacatattctcaaggcaggctaaagtctgagagattcttcttgtattatcaaagtatgcttccttgttatctttgagataaattataaatgtaatttgtaaaacacgaatacaaggcatgagtttggagttaatatcaaaaggtatgaccttatccctaaggttatcccttatccccaagggagttgacttaagagttttttgttgttattttgctttgcatcttatttgtttatttaaaatttaaaggaaaaaagtttcattttaaacaatttaattctcattgaaatgcattttaagtgtgagtttcatcctgtacattttatccattgaatcaaattagacaagaagctggcttttaaacattaaaaaaaaaggcaaaattaaaataactcagtacttaagatgcaatctagggcttaaaaattcacttacaaaaaaatctagctttaagaacagtgagctttcaaggtggctaagctatattaaagtgaagttatacttattttgactataaatatgaatactgattagagaaagtatcacacaactatatgagaacacatttcatttttgaaaaaacaaatttgaatgcctgatttgtcatcttcatggtaaagatatgttggttctctcttttacgtagctcctttagcttgtccttatataagtcaacagggtctcttgattcagggcatagttccgaacaattctgccagttgtctaaatctattctttccattccaaattccaagtgactctttctctttgaaacagatgcaaatagttagtttcacaactttagtcattttcatccttagaatacagactgggaaattgcacactccaggggtgctgggcaaagggtgccagaccatggcaaggatgctggtgacttcaccgaagggagctttattgtgccggagccactgccagctaccctcctccaagcaccgactgccaaaacatcacagtccaaagaggggtgctccgttcccccttcccacctcccccccttcacctccctgcctatcagcatccagaagcaattctttgcatgggtgcttcttcatcctgatcctgactggcagctccaaggattaaactcaggtcctttggagcagtcgctttatgcacattagccccctggggtgttgaactccaaaacctctattttttcccccgggtctaccctgtatctcacaaaaccctagttagccactgtggtacacagtctttcttccattccaggctatcaaaagaaaacaaaacaaaacaccagaccttacaacaatatgatggatatggtaatgatcgagcgtctttagggtagtgggtaaattccaagttctttcataactgagacttgggaactcgttttcttctttatcattaagacttcacattttcatcagcagaatcttgcttacaatagcacaaatgataatttggctgaatgaaaatggcttgtggtgtgtgtgtgtgtgtgtgtgtgtatatgtgtgtgtgtccattaaaaaaagttcctcaaaactgctgaatgaaaatcaagaccagtgtcttcttaatcaaacaaaatttcctgcttagggactgcgttaaaaaaaaaaaaaaaaaaaaaaaaaaaaagaccatctggcctctctctgctatttgaggggtttttttctcctcctcacttcctggttatctttagcaaaacattatcatttctcgtataaattgtttttaccacggtgcatttccttctgtgcattactttaataaatgggatagaaagcattgctccatttcttgaaaaatacttttcagctctaaatggcaggtttaaagggggaaaaaatgaaaaatgtgcttaaaaaaaggaagatggaagtcaaatcacagtgagggcattaactactcatgtttctttaaacacttctgccaaggcaagctctttctttttcatatatatatacatgtatatatatagagagagtaataattaaattccaaaaatgaaaagccaccctacgcaccctaccctactcatttaaggtgataactatgctaaacaccctccaagaaataagtctgaaatggaattaatttccatgtgggaacaaagatgacaataaaaatatgatcaaatctcaattaacttaaaaaaaatcctaattgaaacatttctacaatgcttgagtccactttacttgcataactacaaatcacatattggatctaattgaaaagtttgaggtaatttcaaatcttatttttccttgagatcatcattaaaaagaccttttttcatttgatcataaatagagatgacgtaggagattgacttgaatgtataattgtatccatgaccatggatttttacagtaattcataatatcaccttcttccttgtatttcacaaatctttaggaaaagtataatgtagaaaacttgtggttaataaaggtttgacattttagcaaagttcaggtaagctgaggtttttgtgcatttacatgctaaacaaaatgacaaagattcctgcttttctcactgctgttcagtaagagtaaaaaatgaatgataattttaatatagtacttccgatcaattttgttagcacaaactaaagactatggaatactttgagaaatatataaactaattgagaaagcactagtgtttagtttcccagtggaacacaatggcagctcaagactggtcccaaatgtcctccttccatggtgcagtcatgtccagtccagcttgggctccccattccaatttcccacagaaatttatactgtgccacctgagttaccaaataatgacaccataattgaatcaaattattgcccaacaaaaagagacctctagtcttacattttagcgttccaccctttgatgaaggttattgtagaagacgctcctgtattgggtaggagattgggaaaatgttagctaagatcacttccagctctacaattccaaatagcttgcattgtatgagggaagataaggataagactgggactcatgttctctctctgaatacccacacactctcacactctgtctctctacctctgtctctgtccctctgacacacacacacacacacacacacacacacacacacacacaccactttttcttttggggagaggaagatatcaccaagtcctcatcccccaaagcaatactaggcaaatttattttgaaatcttttatatgccaagaactctgatagctactgagcacacagtagggttttcataaatatttccataaaggactgaatgaagctcaggagatctgccatctctcacttatgggcctacaaaagatattcttagagggagaaaagatcaataatgtcagatttagccgtggtactggtgtttgtgccgatgactattttgaaaatagtacagttgttacacactaaaaataggactgtattgtaaggcatatatatctgtgtgtatatatatttatgtattaatattatcaactactatgtcttgggcacaaatgtgtgaagaacattttgaggatgcatgtattgagtatatattttagatctcaatctgtaactcagtttagagcttgcaaagataaaatcagtgggtccttatttttgttcgctttgtccttctatctgtactgtcttctctcagtatcttttcaccaagccttgccctgaagaacgataatgacaccaaaacataggcactttttctttctaaggacccctcaagggatattataaacttaatgtcttggggaattctgcagagactttccaaactggtatactcaaaatcagtgtcaaggccctgagggtgattgggccccaacttctgtcaccacagtgatttccaggttgattgggtgcacgtgacatccttgggtcaagggtatggacaagtagccctgtgccatatagaaccaccaaacactcttccagcccatagaagcagcattgggaagtactgcggattattacctgctgactgtgtgtgaagttgtccttccaataaatacttattttccttagaaaagggcaaaaaggtctcatgatacattacttaggtaactgttataccctaatagagtagcgcacttgtattaattcttcaccatacaagacaaagaatatatataaaatttggtgacttaatggaaataatatttatttagggagtgatgaattctaggcaaaataaagaatgcatcaatattcctaacacccaaatggttgacatgtgatgcaatttacataaggcttcctttgaatttcattttttggagctttccttcatatatccataactggcatttaaaaaaatacctacaatatgccaggcactttatacaaattgggtctaatccctacccaatccctaaatagtgggtatcattttcccccttctgcagatgaggaaactgagacacagagttaaagcatcttctccagggccacacaactggcacatggcagagaccagtttagaatctgggtttttctgactcttaaagatctctttctggaagtgaaattactatgtcgaagacacacccgcatattcatgtttattgcagcactcttcacaatagtcaagatatggaatcagcctaagtgcccatctacagacaaaaggataaagaaaatatatttctttatggggatgattaggacaatggaatactattcagccataaaaaggatgaaatcctgtcatttttggcaacatggatgagcctggaggacattatgttaggtggaataagtcaggcacagaagacaattactacatggaacaaacctgcacatttaccccttgaatctaaaataaaaattcaaattataaataaaataaaataaaatttaaaaacattaaaaaagataaataccacatgatctcactcatatgtggaatctaaagaagtcaatttcatagcagtagagagtagaacagtggttcccagaggctgctgagggtatgggggaagggaggaacgggtagagattggtcaataggtacacaaagttagacaagaagagtaagttttgatgtgctatcacacagtagggtgactacagcaaataacaatgtaatatatattcaagacagctagaagagaatattttgactgttgtcaccacaaagaaataataaatgcttaaaatgatggatgtggtaattaccccaatctgataattatactgtgtatccatgtactgaaacatcacattgtaccccataaatatgtacaattattaggtgtcaattataagtacaaattttttttaaaaaaaatttctttcctcagcaacatattgctgctacagcttcaaggaattggaaatttttgataaactaatatgaataaaacgtggacgctgtagattctggcagtatttcaactacttctaaactttaattttgaaaagacaaatagttaaacattggtcatgtgttccttcttcaccaggagctattcagaaatttcacaggctaaaccctcccagttctgtcttagaaggactgacatctggatcatattggcaagggggtgctttaaacataagagaaaattaggagaaagacctaagactggattacttccacgagttcactcaccgatacccgcccaagtactgtcttttttcttgtaactagcttgtcacccattctttctactcagtgaacaatggcttgtgacctcacagttagcgagttcataggagaaatatatcagttataattaatgtttactagaataaatgtaaatattttaaaacatacaacagttccaagaacatgtgatttccattttattttatgaaacattaaaaatccacttgtccaccccattaattataacctgctcccagccctgacctgtatataattcctcctgacataaattggaacaaggtgctcagaatagaagcagcctacaccccaactgggctacaaaatgtcaagttcccaaacctctcaaaagtgtaacctgacattttgctaagattagagacagtttatgaatttaaaaagagggcttaaggactcaccacagttaaacctacagtaactcctgaaatatccaaagtaaataggactaagggagccctggggacaccaaaaccctgttagaagagaaggaacagtctttagtgggtggtatttctttgcagaaaataatgtacatgcattcaaccagaattaagaagaatgcaacaataaactttgaggcttgaagccctctagagatctaaaggagtcatgaatgggccatgtgaaatatttctccttttgctacatgtgaatgattgaatttatactgcccattaatcctaaatgttgaaggcaaaaaaaaagagagagagagagaatggctaactttttaaatagtattcttcttgacatgaatataatatgtatttattatacatatgtataatgtatattggtgaatatttataacattcccaaagagcaaaacacctatagaaggatctaaccgcaaagaagcaacattccacaggttgatctttctagtcattttctgtacctcttagccacaaaaatgggatcagactttacgttttgttttgcaagttgttattttaaatataatatattgggtgatttttcatgtgtaaagattcttctgacttttcaagattaatttcaagtaccttttagtacaactaaagtattacagccaccttccaaatcaaatagactatataagctgaagatttactaaatattaaaatgttagcaatttttccccattataacatgcactgtcaataggggcaatattgcccccaagagcgagaaaactagttctcagtggcaaacaaacaaacaaacaaacaaaaaaccttactctttttatgcacaaagcacagatatacataaatagatttatactatatttgtggtattaaaatttcatgcaaggagcaattagcaaaaaatgtttcaacaggctccttgtgacagggggttgaaaatgaaaataggttgtaaacactgcactacagcatcagacttgtaaaaagtggccttcatattgctagagttcagaagatgattttttccattttaaatttatcaaccttgaatacatttttaactcatttcttagttgcagaaaccaaggttccaagcagcagatttttggagagttaatgttttgtgataaccccatggtcagcacatgtgatatctgccatgttcttactaaagactccttggggtctgggttaggaggcacatgttgagtgagaggatgttttgagggcagatgaacacatcatctcagaaagagctagggcctgctaagtctgcatctcaacatttatcagctcttgctctgtgctgccctcttgtgatgtctgggcctccagtatgccttgatctcaaaaccttcagttgccctaaattgatggaccacctgccttccagtgcttcttggcaccaacaccaggagatggtgaaggaaagaagagaacaccaaaagcagcagatttccttagaggaagaagccagtgtcagaagaggaagaaaaagtcacaaaacttcgctttggccctttaaccctaggaaagggtgggccaattttccacaaagctgctgttattacaggtcacacagctcaccaaggagcaaggcaggagctgagattcttcatcaccttctgtggtaggcagactttctaaaatggcagcccaaagatgtccacctgaagccctggaacttgtgaatgtgacatcactccttggattgtgttgtgttacagagcacagttgatgttagaaagggagatgatgcaggtgggcctgacctaatcacatgaacccttaactgctgagaacgtttcctgactgatgaaagaggaatttagagagattctatgtgtgtgaaggactcaatgtgctgttgctttgaggttggagatggccacttaagaaggaatgcagatgtcccttagaaagagtggaccacagcttatagctatcaaggagttcagtcttacagctgccagagagtaaattctgccaacaaccagagcgagcttggcagcaaattcttccctagggcctccagataagagcttcgtctggccaacagctcgatttcagtcttgtgagaccctgagcagagaacacagctgggccacccagacttgcaacctacagagccacgagctaataaatggggtgttggtttaatctgtacatttgtgctaatttgctatgcagcaatagtaaatgaacacaccttcccttctctatgaccatcctgacgggggggatcctggcaatgtctgtctcctagatcacagattctggtgagtgacaatcagttcaaatacagtatccaatcccgggtctctgactgacttcttaacccttcaagaatccacaataagtcttgccagacaagtcctagctcttgacctctgctctgaccaactgtcccttaggaagattttaatcaccttccgcttaatgatcaatttctcagggctctccgctttcacaccctctaccacctggcttatttagtgcttagcatcttctccaagtcaagcatccatctggtgtatttcactctggttgtcttttacctgcttagaacttttctttctacatctagaacgtgttcattctgcctcttcaaatctccaatgcccttattttcctataatgggctgctcaaagattatgtaagaagaaaagtgaaagtctgaatactcttccatgtgttaattttcctgaattttctataggggaaacagaaacagtgatgatatgccatgatcatatgctatggtggaaagagaaggaaaaggattaagcatcagacatggttgaatgtgaaactttcccagtattttatcacctctgcatgtttttaaatttttccaggcctcatgctcctcatttgtaaaagaataatagtaatacttaactcatagagctgcaaggaggaatgaaaatggtaaagacccacataacagaaaccagcacgcacaaacacttaaatatcactgtgagaagaattgaggtggttgtttgtataaaatacttccaatttttcagaggctgtagctttgtaaataatctttttatctcttctattatcataagaacaaagccattgtcacccttccttaagacagggtttagccttgacagttagagtattgtgtaacatggaaacaatgatttgacattagaatgctgtatccattgctctgagaataaagaaagtgagttttaggattaggaataaagttcttcagttgccacatttgttaggatatttctgggttttctgtaaagttgagtaaaccctaggccccatgaaggcagggcccatgcttaattcatcctgagtatctacagggtttggttgaaaactgtgtcctcagtaagtacttacccacttattcatttatttatgcattgaaaaatcagttaaagagtaaaatttagctgggcacagtggcatgcttgtagtctcagcattttgggtggctgaggtgggaagatcgcttgagcccaggagttcgaggccagcctgagcaacatagtgagaccccatctcaacaaagaaaaaaaaaagagtaaaatttctgctgaaaactgtggtgagctcaacattttatttttttgaattctccttatgttcctattgaacatttataactttaatttttcttctaattaataaatcttaatacttctctgatagaaccaaaggggatatttggatacttgggggttggggaaggtgggacatatgctccccaaaatctccaagttcttcagcttctgacttgtgctccaacctgaaaataaacccagaaagtgtcatataaaatggccaacatatttccaactgttttcttccttttgtatttcccactcattacccaggatgcatttccagtgtcctagtggccctgtcttacaccaactgttgcttcctgcttctgaacatcagggactttaaattccagatttaagagacttgcgtgttgaaaagcttttctctttctgtaaattacttgtcattaaaataacaaaggatgcactcattagtcaaattaaagatcatctatctggaagtgtgtcaaatgcagataaagtataaagaagcattgttgatacttttttttttaaatgtggacttaatgaataactttgctgttaaaattcagcagccaagcgcaatgaaaaattcccatggctttaaaattcacagctttggcagacttcttaatggacaaagttcaagagattcatagcttccctaacttaaaataaaaatccccaaaccacacaaggtagcattattatactctgaatactcttaagaaaaggtcttattagctgatgcttcataattatttgctaaaaaagttgagtgttataatttagcctctcactagcttagcctttagacataatgtagcattattgctttaagttttatactggcttaaggtaagtaacgtgcttcccaacaacctgctgattagtagagtccctttctcagtcattaccctagagcagggttctgcaaactatagaccacaggccgcctatgtaccaaatccaggcctctgcctgtttttgtgtggcccacaagctaagaatggttcttacatttttaagtggttgaaaaaaaaattgtttaaatattattttgtgacttgtgaaaattatgtgaaattcaaatttcagtgtctataaataaagtttttttggaacacagttacctccaattgctttatatagtctatgtcgagctgaggggtttggacagagactgcatggccacaaaacccaaaatatttactgtctggtcctttatgaacaagggtgctgacccctggcctagattcatgctctataagaaccgtacaaatagcttgacactttctcccctaatagtgtggggctgtccatagatcctggtagtcacatgatcctgctctgactactgcccttgtcacatatgcacacagacatatacatacacacacacgtacgtgtgcacacacatttttttttccaattattgggaatggggaagaaggagaatgactaatagccaagcctacccctgttccctagggttgtgggaatattctgcttgttccctttggcgaaatggaattggagtttttgtttttgtttttgtttttgtttttttttttttgagacagagtctcgctctgtcgcccaggctggagtacagtggcgcaatctcgactcactgcaagctccgcctcccgggttcacgcccattctcctgcctcagcctcccgagtagctgggactacaagtgcccgccaccatgcccggctaattttttgtatttttagtacagacggggtttcaccatgttagccaggatggtctcgatctcctaacctcgtgatccacccgcctcagcctcccaaagtgcggaattggagtattttaatctgggataaaatctctgtaacaattaagcaaatagtttctgacttttttttttttttttttaccaccaatgaccacttttaaaaaaatttttaaatgcttggatgctatgcttatcattcttaaaaacagctttattgagatacaattcacacattacaaacatccatttcaagtgtataattcagtgggttttagtatattcagagttttgcaaccatcaccactacttaattccagagcattttcatcactcccaaaagaaaccccatacccattagcactcactccgcattctcccctcccctatcccccggcaaccacgaatctactttctggatctatgaatttgcctcttctggacatttaatataaaaagatcatacaatatgtggccctttgtgactggcttctctcatttggcataacattttttaaaaaaccttttcacttttaacttcataaatcctcaggtttagaagtatttgataaaacaatcattgaaaaagtaattatacaatatcttctgggtttttcaaaacgctgaaaaaagcccacaaacttttcttacagtccctagggatgcctatgagtctgggtaatgccatgtaaggcatcattctgccaccacatgctcattctatcatttactaagcaaatatttacagagcacctggtatatgccaagtgtttctcaaggtgtggaacaagacatgcctctcagtttcagatctaagctcttcgcaaccttccttttcattagacactggcttgttttgccaacctgtaaacagcatattgccaacacactgtgcctgcctatatattttccagacttttagtattttatataaaaatgaaaaatgatatttcttaaattattaaaaatgatttaagttgccttcaactttccaagtacctggaaaaagctcctgaatcctcatccccttcttttcctacttatctgcccacatttttgtcttttcttccatcttagaaccgcttttctctttgattaatatcctaaatcctttagcacatgacaataagatattgcaaatagccatggggtatcagacaagcaaagaaacaaaattcacactttggtcattcatgactttttttcttagtatctagctagatgtctgtcatcattgttattgctcactcactagcaaaggttcagaatttctattccagaggtaaactaggcaaagtctctacaatccaggcagagagagcttaaaatagtggcattaaggtcactgtgtattagaaactgaatggtatctctttcctctaatctggtgagtctctcttatgaacagttcttttaaatgttggacatttgtacttactaacatggcttgatcctaaaggatagagtccaaatcaagcacatctgggcatatttaacctggaaaaaatgcccccagaaggccatgttagctttgtctttgaagagctgtcagagaacagagtaactgcacgtgttctgtgttgtagagagggggccaaacaggggtaaaagctatagggagagagagatacagatttcatctaaggacaaactttgtcactgcaaatgatgtctctcattggaatgagcctcctgaagatcccctgttgtgctagcattcctgggggccattagaaaggggttgctggtgatatgacaggaattcaaccaggataaggtttgagaccaaagatctttaactcccaacgatatagattctgtggcaagggtgatgataaggaacccggctggggagaatttttggcttaaagcagctacaatggttcaatcccaaagattggtgcactttggtaagtaaaagagatgatgtcttaatgccaacggtaacatactttttaaagcatttatgcagcaatttaacaaatgaaaaggaaagcattagttaacatttatagttaaatgttggagatttttaacctgtccagatattcaatattatattccttaaaaaaaaaatatttgagccaaaggctaaaaacagtcttttgaaatatatatatttcaaaatacatagacacacatgcataaataattagtctttaaatatagattcttcaaaagtattatatgcctgaacttgctggatcattagacaagagcggcatgagaaaacctgaaatttaaaaacacaggcagtatgtactttttacaagaaaataatgagccacagggaggaacctatcttgacattaattatgaagaatataatactttaaaatctagcaggacttcactgccttagactagaattaatcagaagttctcttcatttcttgaaattatgttttcttggttcaaagttataaatctcaaagctgtatagtttgaaaagcttttagaaggctttgttgtcagaaaaaaaagggattgcctctgctatatacatttttaaggctgacaattaaatattttctcatattgaatatgctatcttatgttataacttgaagggctctgatgagatttagtgccagctagagtatctgaaaatccctacaatttcagttatgacattccattacatggaagtgccattttatcccaaataaccaaggttacattttaaaattttactttccattaattaattcagcaatgcacatatgcaacagataggtaagttttgtgccaggcattgaggaaaattcaaaccttccactgtacaagtttcaaagacttattcacagagttgtttaacaggattgccaaaaaattgaagtctattttttttctctactaacattttatgtacttgctaatctgcctgtcggctcaatctgcagcttttgagaatgctcagctgctgttataacctcagtgcatcaactctaatttgtaagaagatactgtaaccttaaaaggtcaccttatatattccttgcacatattggaagaaaggcaaagatgagcatgactggggattaaagtgacattattaggtttatcctaagaataacatggcttctttaaaatatagtttgtcaggcaattttggaaattagagatatgttatttggggttctggcaactctttgctatataactctaaaaattaattaacctcttggtctatagagaacataagggctctgtaggaaagggaagtgtgcatgatgttactacatcacagactttaaatgaagtcaccaggagaatgcatgcagttataatgttatcacttcacagagactttctggaggaacataaactatatgaagaaaatttgtaccatttcctctaagaagggtgattttagcctacacaagtaatttgtattttcactttagaagttaaaattcctctttgtaatcctataaacaaaggaggatcattttcctggttcttatggctataatgtttcttcctccaatgccttctctcaacataatctactaaaccctttgggcatttttaaaatgtgcattttcaaagtatttttgagtattatttgccatgctatgaaactaatacattttttaaaaagtatcctattattttgggggtcagtctgcatttcagtgtattctttcttcataaattttcttattaaactcatatacttccaagaggctttgctgtattgaagtgttgcttgagtttagtaggctgggatcataaatgcatagaaaagaatgagaatacttcaaggtgcaccttcctctagaaatagtgatacctccggtcactttataaatctctattcctgagacaggaatgcctcattctgaattggcttagcgttcccgggagattcatattacagtacaactcaatggcgtattttactgtcagagccatagataacagtgagttcatgataactactatccaaatcttccaaatgtaacaacttaaagaatgaaaactaaaaccggaatttaaattgcacaactgatacaggaatattttatttttacatgcggttataatttattcttttttcaggtaatttgtaatttatatataaatataagatacatattttaattctaatacaggtaagaatatgcaacttaacagtatttcaaaaaataactattttcaccttattttaattctaaagtagaaatatatttatataccaaatgtaataaatacaaaatatattatttatcaagtaggggtaaatttataaagttaaaaaatacataacattttctataatttatataataattattgttgccatgtagacataatttaaattataaaacactatcatattttcctttgcctgttttgcaattctttaaatgtcttttaaaacctattagaattcaaagataaacacattgaatcagaggaagatccaggaattgtgccaatttctctataaaattctctatgcatatggagatataccctattttatgaggtattttattacctattaaattttgtatctgttaaaataatcatgatatctaatataagtgataaaacatcattaaaagtaaaacaaaaccaggtatgcatgaagtttgcttttcaattatgtgtgttcaatttgtgttttattttattttgttttgttttgttttttgagacaaggtcccaggcgagtgcagtggtgccatcttagctcactgcagaactgacctcccagactcaagcgatcctcccgactcagcctcccaagtagctgggactacaggtttgcaccaccaggcctggctaattttttatttgttttgtagagatggggtctcagtatattgcccaggctggtctcaaactccctggctcaagcaatcctcccaccttggcctcccaaagtgctggagttacaggtgtgaaccacaacagtgccagatccaatttgtattttaaagcattgaatataagctctttaagaaacaaaggctgatatcgttctctgttaaccactaatcttcagccataacttgcagaaacagatttagagattggtagttatcagaaatgaacaggtgggcaccaaaacctgatccccgctggtaaggagattcttatcaagtttcagcaaacccagtgaggtaacctgaagcctgagattctccttctcttctgtctaccccagtgattctcaaagggaggtttattttgcccccagtagacattttgcaatgtgctgagacatttttggttgtcacactttgggggcatgggagtgttactggcatccagttgcttaaggccagggatacagctaaacatcctacagtgcacaggacagccccacaaataattatgaaaccccaaatgtcaatagtgccaaagttgagaaatcctgacccgggagaatctagactggatgttggggaacatttgggattgacgcccacagagccagtgtatgtatgtctgtgtatatgtatgtttgtagatttacacacatctacatgtatattgacaatgaagacagatcatgcccctatttaatttatgcaaatgcaaaggcaatggaatatgttggaaaaggggagaggaatttaaatagtcttagcaatttttcctgatacctaatgtgtctattcctaaagtgaagttaggtgttggggcgtgcatctgccatgtcttgagcaagtaacaattctctgagtgtctcagagtataaattgaagcccagtctaatgttcggatatattttgcacaacacagtttcttttttgctctcaatatttcagttaaggttcaacaaaaaaggcagcaatcatagatatttttgacaattcagtcatgtaccaagataggcccatattatgtgtgagaattttacctgggaggtattgaacacacccaaactggattatgaagtatcttctgcactttttgaaaaccaatacaaatgagacaccactacacacctaccagaatggctaaaatgaaaacagggacaacaccaaatgctggggaggatgcagagaaagctgggtcactgatacatttctggtggggatgtaaaatgattcagccactctgcaatacgctttggcagtttcttacaaaactgaatgtgtacttgccatatgacccagcaattgcactcctgggcatttatcccagagaaatgcaaacttacagtcatacaaaatcctacacacaaatgctcatagcaactttgtttgtaatagctccaaagtccttaaacaagttgatgattaaactgtcatatatccacaccaaggaacattactcagcaataaaaaggaaaaaacgactgatacatgcaacaacttggataaacctctagaaaattaagtgagcgggaaaaaatgtcaatctcaaacaattgcatactgtatgattacgtttatattcttgaagtagcacaattatagagatggagaacagatgattactggtttctgggggttagggatggggtaaggggtgggtaaagggtgcagactgcccagtacatttttttgcaacttcctatggatctgtaattatttcaaaatacaatttttaaaattatgtttctgtaacaacacagccctgggaaacaagatcacccaaatggtctcattcacagtggtagagttgttttaaagaccagtgttatattctcagccctcagcaccatgccctctaaaatgcattttttccatttctaccttttgtatttactgctgtgtttatttttttgttttaaagacagaaatacataaacatgagtataagtgtaattttatttctaggtatagctgtaagtataaggtgtgtaacattgtaaaagagtttaattgttgtaaagaataagatagatgaaggaaaaatatgcttttttggattataatatgaaaggtagtgataagtgatcatgtccatttaatactatttggtgttgttttagcatattaggataatttgtccgaaaagggtacatttttagcaacaaattagttttcttacattacagggatatttatacatatacatgcacacgtgcatacacacacacacacacacacacatttgtctaaagagatgcttttgaatcattacagccatttcagatattattccaccgtgtgtacatatgtgtatatttacatgcctctgtgtgggtggatgtgtattcattcagagggtaagaggtagaaatgtccataaaacccagccttctctgaaaccttaagtttgtacctaaaaaaagagaagttaacctaacatttttaagtgcctagtatgtaaccaatactctgttaagtgctttatatatcatttatatatataatccttcatttagtgattattctataaaccctgtgagttgtccacatcatttcaattttacaggtgaggaaacttgggaagtttaaggaatcaacccaaggtcacagagttaagatgtggcacgttagggtctttactcgagggtctctgatagtgtgcttctaagtctactgccgggagtgattctcttactaaatagtagttttatcattgtcaaaaaaacccatcaaacatcgttgtactagacctggcattttctttctttctttctttcttttttttttttttttttttgagactgagtctcgcactttggcccaggctggagtgcagtggcgcgatctcggctcactgcaagctccgcctcgcgggttcacgccattctcctgcctcagcctctagagtagctgggactacaggcgcccgccaccatgcccggctaatttttttgtatttttagtagagacggggtttcaccgtgttagccaggatggtctcgttctcctgacctcgtgatccgcccgcctcggcttcccaaagtgctgggattacaggcgtgagccaccgcgcccggccttctttttgtttttctaaacagaggatatgagcagacattgcacaagaaatgcaaatagaccttcaacacatgcagagacactcaacgtcactcagaagagaatgcaaagctacacagagatgccgcttttcagatatcagataggcaaaggtgcacaagttggacaatgctctctattgatgaggctctggggcagtgctctcacacaggctggttagacaatgttatttatttatcaaaattagaaactgcatttgccctttggcccagcaatcccacttctggggatttttaatacagatacatccgccccatacaaactgatgaacacaacgtttttcagtgcacattgctttaatggcaaaatattggacacactccacgtgactagtaggggaagggtcaaatcaattatggtacatcgtcatagtgcaatgatatgcagttttgttttgtttttaaagaggaagctctctgtggactgttatggaaagatctctagggtatactctaaagcagaaaaaagccagggtgaagaataatgtatgtgaaaggccactatttgtgtaagaggagggaaatatatttacatttgcctacaacaagcagaaaaattgctgtagaaattgatatcacaacaggagacacatggtatactataattcacaactttgggcagcttgggaatgacgatgtttacataccaattagggactcaagaaatcctataaagtttttcttcaggatcctagtattcaaattagcataaggatcagacatggaatataatctctgaggtgaatgtttcaaacaatgtttgaagccccctgggatcacacaattaggagttgtgcctatctcaattactttcatactgtttctttacatgatccaatgctaatcaacaatttacctggttaaaatttagttggtttggttatgctctgaagaggacactcccttcttatgttttctgcactcaggcaggagacttgtaaaggagctaacaacaaagggatttttaaccttcaaagccttaattagaaaataagagcaaatggtacatttttaaagaggaaccaggaatacatattcttgtgggcttttgcctcattacatttgttaataaggaatgccaaaacatgtgcaccaaaaagcgttcaaggtcttttggtagtaaattatacttgtaaatttgatgtaagttgatcacttgaagaactcacactctttgaagattagaattcataaatgtatgaaagaattaaatggttctttcctctagtgatataaagtattaaatgacagaaaaaaatgtgttcgaaatcaactgcggaaataattcattttgaaaagtattcaataaaaatgttaaatgggaaaaatatgctaagcccgtttctgctggatgaagaagtaaagcagaaacatgaaaagggcaaatttaaggatgatgggctgggaaatgtcccatcagcctcacagttttactttttgttattcaactatggcagttctaggcccagtaatctattccatccccataagacaaagaaaaaaagactaattctgatcagcagaaaactggatggcctctaggaaccttcaagagggcagtagctccggatcaaggagaaatgaatgcctttaaagaggcatcttagattgttttgttaatacataaaatcctctctctttatcatgcagaagtctcatttcaaaaggaaaatgcaagtcaatgaggattagtttggctcctcagaggtcagaactaaatatacaaaaactaataatatgacactgaaataaacaagaatgtggaattgctcatccgaagggatgatgtaactaatattgacataatttccaagcagaaaagcaaaactaggtcaaagcacgatggcctaacataataagcatttttgtttccagatttttaccatgtaggctgtgtctgcaggcattaatgtcttctgttatcaatgttcggggctgtcacaaacaattcatgtcttatcactctttgttagttaaaccaaaacaatgtagtttatatgtgaaccattcaattctgacagctgaaatgttagaaagcggagaaatattcagaaagtgtctcttccagactgagaagcatcaagcaataaatattcattatctaatagtctatcatgtttttatctactcagaaagtcatacccctctcaattaattattatgactgttttccctcttttagtcagagccgtacaaaaagggcagcaacaatctcattaggatttcactttaaacattgaccactgaaaaggaactcaagtgaatcactcaccaaatagccaatttttctctaccgctttccccatcatatgttgactaaaagaagtcacgctttcttctctcgtctatttgttccattttaccttcctgcactatttcctcaaagcacagctgattaattcatgggctaaatgactcatctcattccctaaactttcttttatataaatataatcctcctagtttttgctgtctgacattttcatacttaactaaaatcagagcaaagaatatacacataaaagaagcacaaaacccaaatataagatcatttaactatttggattttttggacagtattttccactaaagatgatgtagtctttcctgagttgcctcattataaaccaacattccattcaaattgccttggaatttattagcatattgaattatagcacatgacctgaaaacatccaaattatatcttagtagaaggcatgtggtacagtcacaaaagagaatgagatggggagtctagaagacttagcttctaggtgtagaacctaagtctccctcataccttgctcccagatggagggtaaagtgtttcttgtgctaaaacgtcaacccagaaatgctaaactttaaccagtattcttagtctggattcctaatgtatttcgtacagaagacttgatcctatgtaagtaaataaatctctattaataatatttggtggtgccgtccatctatatattgctttatttggccattcatctacttattattaactcagcagggcattcaatgaattccattttcccagtaacatcccccttcctccgaattgtttggggaagaccacttctaaatacacacaaccaaagcaacactccaaaacttgacataggacagataccacagtctaccgcatagaccctttggtaatatattagtcctgttgtttccataaactattaaatgtccctgaaatttctattttgtcatttttaactataacttctggtctgttacacctaccagcaatgaaaatgctttgtccggcacaaatcttgaacttcactatgaaaaatgtggccaccatctacatggagaaggcttcagtcttctctcagacacgctatctcagttctggagtaaccttgggcatgccactcacctgcaaaattaaacaactgcacatggacctaaggcctaaactatcaggctgggttcaatgagagaaagcagcagattctatcttggcgattaggctttgagctattggagggcatgacccatttcgtaatcatttctgcagaacaatcaaacagaggataagccaagctgcttaccatgttttgggttgtgttcttgcccagaacacaactgaaaggaatatatatatatatatatatatatatatatatatatagagagagagagagagagagagagagagagagagagacagacagacagacagacagacagagagagactatgtgtatataaatggactatatatatataaaaccatatacatatagttcagtaatcataacctatgctaattttctctactactgatctatttagtccttgctgtttcccggacctttctaatgccctttcttcttcatatcccttcggattttaaggagcattttccattctcttttttactaaaattcacccagcatgtgcctgtagaacacttaatgattcttattgtgtgccagacactgggcttgggtctggggattcaaaggtaattaatatgtgactcttgctctggagtaactcagttccaagataagcagacaaacgagtagaaatatatacaccaactcaaatactcgtgtggataagaggatgctacagctattttctttccatttattctaatccaagtagacagtgctcagcatacaaagagcatacttacaaacaacccaaacccacaaacgccataattccctctcaactgggggcctgtggctccctggctgttactcacaaagaccctagtgggtccagaagttcaggcaggttgctgagaaagaacaaatgaagaggtctgacccacgggcagacacaccagcaagttctgtctgccaaaggcatggccctgcccccaaatattgtccctgaaaggaaaatcatgtgttttgtagctccaggctccactgcttgaaatttccccaattaaagattcatcctaagggttaaagggataagagtcatgagctttggctcacccatattacttctttcctgccatgtggtagagaccattgactaaaggaaacaggagagtggtttggaggtggggaagggaagggtgggaagatgaacaattatgaattcactatatattaggacaggcctgggggagatgccccagtgagaccagaagacatcagaaggatggagaaagaaaggtgaaaactagtacgaacttcctatttcaaatattgccatgactggcctattaccaaaagtatgccaattctttctccttctgtttccatcctgtataacacagtggcatgtcctcaaaacacagaacttgatctcacattaatcagattgattatttttcgctggaaaatgctctgggtttcaaacaacaaactcctaaaacataaagtattcctagattggggactacctatgagttacttttctctattgagaaaaataaattactatttaataattatgagaaatctgctttatgtaagaagtcataaatttctacaaatggacatgtgggctaaaaatcaactaaatttcacaattacaaatcacttctcaagtctcctaagttcagtaaggttttggataccatcagtttttcaagtggatccctacccatacaaatatagatattaatgagcatccattttgaccatggaaaaacctacattatgctactggtacaataaattgtacaccagatcaaaagttctttgagggcaggggccttaccaaagtcatatttggaacccagaaagtgccctggcacattaataatcacgtataatgtggcagaatatattaattctgtgagtgctcagtaaatgtcattgaatgatataagaaaggaaggacagcctttatattatattcatcataaacactggactgaatataagaccttcaacatccacttgtactacaaatgatcagcacctcttccatgtttactcagaacctctctttcatagcgcaaagcaggtaagttattttctttggtctggtttgttttttcaggaaagtcccctcttggcattttgttctgcgcctcaattttctgtgctcctactatcacctgacctcctggaggccattaaccatcctgatcttgtgtcaatggaatattttcctccagagggggaaaaatatttcggatccagatggctccctaatattgtgtcctttttagtttaaagaaatttttataacatgccagctcataaaactgggcaaacaaatttctagaacaaaaccgctgagctcacttttgtgtgaaatcaaaggaattgataatgagccagaatcttcccgataaactgccttacatgtaaacggagattagattgctgtttgacctggctttatcgccctttctttaatcacagcgtatttgatattctcttccttgaatgaactcattttcatagtagctttggtcacaagattaaagaatcgctaactaattgttccaaataagcagagcaattctctctgactctgcctcgggctccctgcagtgaagtccgctgcctgatcttccgaccacgggaacttcaagcctgacccctgcaggtagataactgaaatgcacacctctaatcagatcctggtctttcaaagtcccatcaagttctgaaaataaaaacgttcatacttagtacaatagggatattgatgatatttatatgatatattgtacttccttttcattgtataaattgcttttggaaagtagcaaccacttgtttaaaaataattaaattacgtctgcaagatactctggtgcgcttagccattacttctttttgcctattgagaaaaatccaaatgatttgattgaactgggatcctcaaatcatgtgggttaaaaatgtcctgatttgcccctacctttttctaatcaaacaaattactctttgtccagtaactaaatcccctcctttcaccaacgcacagcccaggttgccatagctaccttggatgtctatttaccacacaaacgatcaaagccaggagacatccacatatgcacttagccttaaaacttgctggaatgtctgtggataacatgcaactaccaattaacggatttgcttgtagcctatgcggtctacagccaagcgaactaaaaacatgactcaaaaaaattatttcaaaatgaccaacaaggatctttaaactgacagcaagtcttatgattataacatttgctgaaagagagatagcagagaagaaattaaaattttaacatatgttgaagacactgagctctataaaccatgtgcaaaaacttaaaacatctgttgaaagggaacatttctcagatgcatatttaaaattccagttagttactgtatctttctattagatttcataaaagctgcctgatctcaatgttgggagaaatgagaacagaactgccttttgaactgttaagagtctggactttcaaatgaaggaaaccatacaacatacttgggacacaatatacttgccagttacagaatgataagaaaaagaatgtcgtaagagagattctgttttaatccctagaatgccatttgagatcctaaacctgcacaggtagtctttctgggtgggtgagtattcatccccagacttgcccctaacttgctgtgtctctttatacttaacctttctctgccttcgtctcaccatttgttcaatgaggatcaaattgccacctcattctctcctggggatgtggcagagaataaatagatcgtgtttgtaaaggactttctaatcctcagaggaaagattaatacgaagactttcattattaagccagatgtccttgggcattttaattccaatctaaagaatgcagaacgggctaaccaaacagattcacggcttccttgaaacagcagcatcctggccttgcaagaatttagcagctacgtgacttactttgttttagtagatcagaaatacatcatgcaccttcttcccttagagttttttttctaaagttatcaggatgttaaaaacacaaaatatgtctagtaggcaattttgcctagagaatctgatttttcccccagctcaagaatgaactatttgttcttcttgtgtgtagggacaatgggtggcttgccatgtggggaggatatatgcagttgcgggaatgccacaggcaaacctgttgttttcggccaggcttctagaacaggtggccatgcttttccttttgcctgggaacagagcaaattccttctcaaggaaggttcataaaagtttcccgtttatgatcagagggcagagacaggttggcacatattttaaaattacttcctgatcaaggtgaatcagatttacacttttctttggcctaactcagccgtggccttaggaaccctcaaagaatactatccttctacacctgaagtggtggcttcaggaatgttccttttctgccaacctggcagaagcccaaacccctctgaatcttatagctaggcaaacagccttctaattctgcgggcaatttctggctacccagaatttctggctatcagtggcaggcaggggtctcttctgggctgccacaccagtgtacaacatttgtgcagccctagggacagatcactcatcagcaaagagatccaatttcattgctgagctgatgacacacaggtctgtttgatagttaaccctgtaaatccagctggagctgccgggctgagatgacaaattggctggtgaattcgactcaccctgcctggatgcaacagtcaggtttccccaagagaaactcaaataaagtagggattaacccatgccaataacactgccatctcattcctccctacattcttgttctgactgcagtggaacaacatgctagattctggaaactgtcctcgttctttggatgaacaatgatcctgtctctctccttcatctcctcccctgttccatcccaccctctttcaaagttctgaacaggccaaaaaaattagtagacatacgtagctgtgagatgaaaagttgcccattcattaaataactaaggagttcactatatgtgtacttgtacccctaaaatttcaatactgggctgttttccaacttcacgtaaatgccacaacaaactaggcatgggaaaaaccattccaagctgggggaagcaaaccttaggcataaggcacggagactgccatggttcctgaggaattgtgtgggaacagggattctggaaattgagctcagacaccaccgaggagaggacaggtggctctgcacaggatcaaataacttctttgttccagctaaggacctttgtcaaaaatgttttgcgttcctctttttccttttcaatcctttccaattacccttctccttccttttcctcatcccactttagtagacattaaaagtatgaggttggactgtgagtttgcagaacttaaagacgtcctccccacagtccctaccaaggcaagggcaattcattgcaagcagacggcacttgctcctccgcaagtgtttttctgcactcactgaaacttgccaagcctgcttgctgagcgaacaagcgagggggcaagaaggcggagggtttgcgctgaccattcgaagggggctctgcttcatctcccaaggctgtgggaaagggacagaaagttcgaaacccctcccctgcgctcttaaatggaaagctcacttcccccaaagtgtgcagggtggcgagcacccaacccacttagaagaaaaagtgaagagcttttccggttgcgatacagatgctaactttcccatccagatttattcagagctggtaaaagcaatagcattcctcttgaaatccctgcccttccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatctaacagctctagttctgctaaaagcttaactagctaagggccttaaatccttgcattttaagagctccctaacagcattaaaacatttggaaggtgcaaaattatttcagccagaaaagttcaacactcaggacccaagggtatttttaaaaggatatcttgcactgaagccctacttttgcaaaagactggaaaggaaaccaaattgttatgagtaacaccttaactaaaacgaacaatccagaaaggagggtgttacctacctcatctgcatatagattaactgtatattcaatttaagaaaaataaatcttaatgggaacgtgcacacaatttttttgaaatgcagcaaatgaacaagaatctttacctactgaaggcccgaggcataatttcaaataacactattgtcatagaacaatacacactgacattttgttcagaaaaaaaaaaatttagtgcatccacctttctctatggtttggcttccctacagggttgatctgttgaacttattaacagggacaagctggacatcaccttggcaggattgcaggagagctggagaagtagttggcttcttagaaacaaactcagaccaaaaaaaatttccaaagtttgctttcttaactccatataagcaataacttttttcaactcttagccaacatgattttaatgtaaatctaccttctggatttcaagaaagtgcaagttgagcaaagagtactttgtgtagaactaatggcatattttcccccaagaaatgaccgcaattttgtgacgataattcaataaagattttaaatgtgttggtatcagaggaaaaaaaattacttagcaaataatgcattggtggcttcaggagtgtcagctgcatgggttcaatacatgtgagctctgcccagttctgtgaaaatttggtggtccgataactgggcctggaagcccataacgctagccccctgcctgagtagcctaaggagccacctagtgacacaaactgacttcagtccacttcttgtacttttccttgagagcccttcatatgatggagttcaggatttctcaatctcagcactattgacattttgggcaggataattctttgtcgtgagggctgtcctgtgcactgtaagatgtgtagcagcatccctggattctgcacactagatgccagtagcacccccacaatcgtgatgaccaataatgtctccagacattaccaaatgtctcctgggtgatgaaatcacgctttgaaagggtggttcttaaacttgagggtgcaaggaaacctctggggagattgttaaaaatgcaaatctccaggcccctgcaccaaaataatctgattcagtaggtttgctgaggagcctgagaatcagcattttatcccactgacaaaggactctgatttactttgagaaatattgcgtctatcccagccctaggtatgccccagccacaggacacaggaagctacccagggctcctgccattaaatactggagcttaatcccatggcacatctgtttatcaccttcagtagaagctacaactgcgtctgccttctgctttcatcacctcaaaggtaaatatgagctgggatttcctctctcaaggactgagcccttttaatgttccttccatttttattctcctttgactcactcaccaactatccaacaatctcaaatgtcaccactcattcgtgatttccccaaatgccccaagaaaaattaatcccttccatcttctatgcccttaaagcaaaatacccttataaaagaggtttcagagagcctatttgccccttctgccatgtgaggacacagcaacaaggagccactgatgaagcagagagccctcgccagacaccaaatctgctggcaccttgatcttggatttacctgcctccagaactacgagaaataattgtctgttgtttataaatgacccagtctaaggtacagtattttgttatagcagcctgaactaacacagtgccataaaatatgctgcctccatgtttcagaaaacctctaaaaaaaatgaaaggtggggatacacaaagtctttttcatttacaaataaacaaatggaaatgtttaaaattctgaatgaaataaatggtcctttggagaatgttcattgagtgaggatttgatccacctattagaaacagtgaggcccggtgaggtggctcacacctgtaatcctagaacttttgaaggccgaggagggcggatgatcgcttgagctcaggagtttgagaccagcctgggcaacatggtgaaatgctgtctctacaaaaaaaaaaaaaaaaaaatagctgggcatggtggtgtgtgcctgtagtctcaggtacttggggagctaagacaggaggatcacttgaacccaggaggtcgaggctgcagtgagcctaggttgtgccactgcactccagcctgggcgacaaataagaccccgaaaaaaaagaaaaaaaaataaagaaaggaaagaaagaaagaaaagaaagagagaaagaaagaaggaaggaaggaaggaaggaaggaaggaagggaaaaagaaaagaaaggtgaagtgagtaaaagagcttgctctaccaaacgaacagatgttctgttcccaaatctgtgattaaacatgtttgcaaatattagctgaagggatgttggaagttttgaaagctcttcttcaaaaaaagcagcctagtcgataatcttgttagttatgtgcgggtttggttattaacagaccttgtagcaaacctaacataggttctgggtggatagtcctggacaggcagcgctactcagacatggacaggcattgctgtggcgcccttggacgatacctaacagtatttgtgccacctctctcagtgatctcatagatcaaagaacatggagtgaatgtttgtgtaagtaaaaaatggctgaatatcagcaatttcacataggttattttaatgtgtgtcaggacacatcaaaagtcaatgaaaatcaagctgaagttgtctatgcagccacctggacagtgcccagtacaagtgcacagactttgggagctatgaaaagagcatgtttattctccctcagaggtttcagaaatccagttgttttattatcgggacagagggaaatgtatggaataccgtgttcgaagtgattagtaaaggtaatttaagttgacaacaacatgagtccccacttagaaaaaaaaatctcatctataattcttatagaaagtcacaaaaagagaaaaaagtttctacttcctgtgtacaggtactccttaaattagtttctttcagttggttaagggaaacaatgtggcataccacaaggatgggccaaataagacttggagtcagttttctgtgctgacttggtcactaactggctaatagacctcagataagccagttgatacctctaagcccaagatttctcaggggacaattgcacagcttgaataaattcatatattgggaagtgtgcccagtgcaatcgctattgcttgttgtgtaaatgtgttggatgaccaacactggaaagaagggaaaaaatctatgtagtcagaaatgtaccctaagcttgttgtttcctcactagaaaattaaggaatcaaagcaaatcatgtcatttttaatgttaattaaaccttactatttaataattctatgcttttaaaggtgaaatattttaacagcatctagtttgtcttaagattaaatatagcagattcttcattatctgcccttgagtaatctggtaaatggtttatgcatgaatttttaagatttttattttatttcatttaactttattacttttttaaaatttttttgaaacagggtctcactctgctgcctaggctggagtgcagtggcataatctcggctcactgcaccctcaaccgtctggactcaagtgattctcccacctcagcctcctgagtagctggcaccacaggtgcatgtcaccatgcctggctaatattttttactaatttgtagagatgggggtcttgctatgttgcccaggctggtcttgaactcctgggctcaagtgatcctcctgcttcagccgccaaaaatggtttatgcatgaatttaccaagggcttgttatatcctcctcctgtggtcaaaatctccactcccaattgaactttctacttcatttcaatacaataatatcatacttcccaagaataattcttcaatttctgtcatttattttttactataattttttatttaaatttaaagaggaaaattatttaaattaattattttttaagtgattgcctgtatcagtcagggctctccagagaaacataaaacaggcttatgtaactatggggtctggcaagtctgacatccatggggcaggctggcaggtgcggactctgtagacttgaggcagaatttctccttcctcagggaaacctcgattttgctgtaaaggctttaactaatggggtgtggcccacctacattatcaaggataatctcctttactgaagtcaactgattgtagatattcaccatatatgttcaatataccttcatggcaacaccttgattaacatttggttgaataagtgggtactacagcctagccaagttaacacataaaccgtcacaaggcccatgcccaaacatttgtatatccattgcaacaacaagcacagagtgtgtggtcagtcaataaatgtttactgagttgttgtgactaataataatattaataattttaaaatctccattagtagaaggccgtcttctttatcaataatgaaattttgctaatcgatttattatgtacttatcaactgcagtgctggaagttaagagctccattttatttaattttgagattaagtgatttctagctgacagttctttaccaagtcatactatcaatcaaatgtcagaatataatgcaattgttttcataccaaggctcaacatttttgcatcccatgtactctttctttggaaaccactcaaagatgtgttttagcaaaatgagagtgttaaactaagaaagataagtcaatgggacccagaaaatagaggaaccaacataaaaagaagtaaggaaagtccaggataataactacataattatcatgcagttgtgtgcagcatcttagaaaggccccatctaaattgtagcaggaggatggaggagtcctggagttaggactctgggggaaaaatgatactataggtaacatttgagggcaaatagttacacataaatataagcaatatgtgaggctattattaactccaggcaaaacaaaagaatgcacaaaaaaaggaagcattgttatagaacagtccttaacttggcagtgatttctgatatagatattatggcagagactactggtagccaatccagtattcatcttccctttgcttcttttcaacagaacctcagtttacttggggcagaaatgtgcccagctgaagaacatttcccagccccctttgcaggtataggtgatcatatgaaactattattattattattattattattattattattaaagactaggtctcgctgtgttgcccaggctggagtgcagtggctagtcacaggcacactcatattgcactacagcctcaaactcctgggcacgagccatcctcctgcctcagcctcccaagtagctgggactacaagctcacaccaccatgtctggtaggcctatgaaattttaatagaagctgctatgtgctatgtagggcttttgggaaagctatttaaagggaacacacactgtttgctctttgcccttcctggatttctccaccaggaatggttgcaatgtctgagggactggggcctttctgtaacaatgacgaggacagaacacctagtaaagctggataacagaaaagatagaaggatcttggatttctgatgacatcctggagcctccaaatgagccctaagcttcatgttctatgaaaaaataaattgctaatttgtttgagccaatgttttgggatctgtgttactgggtgaacataattcctgacaccattatattggaagaatgtggtattgggatgaggagggctaattcctttttgatcatatgtagaatgttaagaataatatccaaaattcataaaccaggaaagagcagtaaaggcacattatgggaaatatggagatacatagcagaggagatatttgccagttgaaagtgattgtccctagggtggagtgggatgggacagggattactgtttttcattaagagtctttcatacatttgtatgttgaacatgtattactttgataaaattaaaattagtttaaaataaacaaaaagatactctctggttattaaatcaatttcttgtccttaaagtcacttcctatgaactagcagtgttttattatcatctggcccatagatgaccagagtcgtggtagagcttcagagaaattatatgcctaatggtccattctgaaacccaagtgtaatgtgatcacgtcatacacatatgacctgattggcatttcctgtttccaccatttcagctttaatttgttcaaggcttatgatagtttttccacatgtaaccagagatacatatagacagttctgatccaaattgttttggacattcttttagatctccaggaatgaatattctatatccaagacaccttaataattcattagagtaatcgaaaaccaccttttgttcttattcctaattggtatcattcttgatttaaatccattttttgtgggtttttgtatgactaggaatagctggttactgtccttcatatttaaccattttacttcttattcttttatctcactttccttatatacgagaaagattagtccctcaaacctttaatattttaatgcacaaagctgatatttaaattagtcttagagattaaaaatattaacttttatgaatcagatctctttttttgtatgttagaaacaagcaaatcaggctggatcattgataagcatgtggacataaggaggtgaataaaaattttaatcaaaagaagctttgaacaggatttgcgctccttgcttacaaaaagtcaatgctttatcttttagattggtacttaaatgaacagaaagattgccaggatggttgtgttatttctgattggtgaaaatcctctcccacttcacacatacctggatctaagatggtagtaaagataaaaactacttaggaatcatggtttatgtgtcactttcctttgttacacacagatcatggtgtgtgtttttttttaacatttttaatggccaaggaaataatatttacccttatttccttataactaggtaacttgtcataagttttttttttctgttgagaaccacttatgaaaatcaacacatactgagataggctttcttatattattcccctgatgcaaaataaacatatttagtcatggcaagaaaaaaatgcaaacatgggtatcagtgcctcagcttttcccatatttattaaagaaatctaaatatctgagaaactacattcaaatgaggcttcattttatttctcctttgaatcattaatttacaaaaggaagggcttatattgcctgtctacattatcttataaatagcaatgctatttaatattattttaatgtgagtgatttaaatagcatcatacaatgaacaaaataactattctttttcatagcattatttaagttgtaccacagtgccctagtgatatttgtcctaaactatatctgtgtggaaaaaaaagataattttgttatggtcatctttagaaaccaaccaattcgcaaataggtggacttttcttcaactgggcaaattaatttagcccaattaagggaatttaaaaccagctgatacaccacacactgagaggtctaatgagataaaaatacgagtacctacattacagagatgcacaatacaatataatatgatataatataacccaccaggaggtatttgtgctgaattaaaaggcaggcaattgaaaaactctcgtatctatcatggaccagttatacatcagtccctttttggacatgcaggaagtgtacagttggtatatgggacatcggaatccatctctcaaactcgagaacccatactctttccagcagcatgtggtgctggcaccctagttcagatgcaggtcccctttggaatgaggctcaaaatgcagtatgcccatgactcatcacaaacactccttcacctcctgtgcctcaatgggggtgatggaatttaccacttagatggttctaagatccccaaccacaatctacctccaaaagtctctcatgttgcaccttcaagatgagtcaggaatttgccattacatttggaagcaaactgaagcactttaatgattttttttttttttagacagtcttgctctgtcatccaggctgttgtgcagtggcgtgatctcagctcactgcaacctctgcttcctgagttcaagctattctccagcctcagccactctagtggctgggattataggtgagtgccaccatgcctggctattttttttttcttttttagtagaaacagggtctcgccatattggccaggctggtctcaaactcctggcctcaagtgatccaccagtcttggcctcccaaagtgctgggattacaggcgtgagccactaagcctggccagcactgtaatgatttttaatcaccttaaatggctctccaaatttgggctgtgttcatccaatcaaccagaggtaggaaaaaacaatgcatttgtctgttaagggagtagccctcatggaaaaagatgttggtattgtgctatgcagaggaggatttggattttagggctctttgtctaggactgtgaatgaggttttccttttccattcagaattgctgaatgatgttcctagtggaatacgtttgtgtgattcatttccacagttaggaatgcagccttagagcacttttctttattcagagctaattggtgcatcaatgttctagccatcgatttcattagcaacatatagatagatatctgtacatctctatgaattgattttcatcactcccagggaatccaaagatctcaagcatagagacaagtgcttcatataagaaaaagaatcggagagactctcatgccttaaccatatgctaacaaagatggtataccttctttatgccagaacggtcataggtattcagtaagtatttatggactacagctataacaccctgaacatgcctgatcatgtcagtaagtatttattgggtgtctactatgtgccaggcattgttctaggtgctgacgatacagacaggtacaaataggttaagtgctgctgtcatgagcataccttctagtgaagggagatagacaaacacatcaacaaataagtagaaagtaggtctgatggtgataggggctattgtatgtggggtaaggagtgtcaatgggatgaggagtttctatattttatagggtgatattttagcaaagtcctaaggaagtgaggaagcaagactttcaactacagtgatggatgggggcagagttacccgggcagaggaaacagtgattgcagaagctgtgaggccagggtgaactcaaccaacgcaggaagcctatgtaggttggagcagagggaggaagcactacagtagtaggagctgaagtctcaggaatgtgtctgagggtgtatgtgtgcggggggcgggggcagtggttgtgggtgggtgttggtgaggcagtgtttgcagatcctgtagggtctagtagatcactagaaggatcttgggttttccttggagtgagatgggaaggtttcagagctcaggagtaacaatatccaattgatattatagagctcagtctgactgctagacagagagcagcctgcaaggcaggagatgttaagagatgatggtggattgggacgggggtggcactggaagtggggtgacttggggagttcctggatagattttgatagtacaatgagtgtggcttgctgatggactgtatgtgtcagataaagagcagaaacgaggtttccaggttgtttcctgggacagctgggagaatgaagtcactatttactgagatggggacaactgcaggaggagcagttgataggagggaccacaaccttgcttcagtgtcctgtgggaggggcagtctggaggctttgtaaaatcatccagataacaagaaggtccagggatatttggatcatgcccaaaagtttatactatacatggaaaaaattgaacataaatacttaatttattattcccaatcaatgcagtatagcactgtggctggcagcactgatgctggaaacagccttagtccaaatatcaatcctgtcacttaatagttgtgataagttggcccatctgcttaatatccctcaaagttattgtgagaattgaggtgatttgtttaaaaataatattatttaacatttattgaatgcttattagaagccagacactgttgtgagcacatttaatcttccttcaccctatgagaaaaggtactaatattatccccattttccagaggagaaaactgaggcacagagaggcaaagtaacttgccaaagtcacacagctaggaggccatagatactagtttgtgcactcaggctgaccagttcctgaaaacatgcccttaaccatagaactatgaggagaacacagcacatagtaaatactcaaaaatagtagcttgtattatgatcaggtaactcataaaacaaaaacgtcaaagagtcagttgtatgtttatatgactccacttgtaatcattgcatgactcagtttccatcgtgcattgctttctccagctctattttgggtacgtagcccatattcttccttccttgatatgatgaagtctttgctgagaaaatcagaacaaaatatttatcatttgaaagttcgccttaaaaatgcccaaggcacaggaatccttaagagtcataaaatccatcacaagcatggagactttttttctgtcattaatgtcatttaggactgtaacatatttacctatgtcccagataccgaacaggaagcaattgttcagacacacttctaagtagctccagggcaggcaacaatgtctgacattagctctccatatttgtctttcctttgaatcatggagctcacccttcagccccaaagtgctttcagatgggaccttgctgagcgtctgcaccttatttctttcaattacgcttgcattgtctggcctaatgagtttccaaagctagttttcattttatttagggcatgttttcagatgtgttaaattaattggtgctaaataaaaggtaacctgacccctgaagcttctagcaaatacattccattaccaaatgtactattctaaccctcatatgtctaaaaaaacaaacgtaaatgagctgtgctgtacctgtttcttcttgttgtgtatcttgggcaagtcacttaaactctctgagctacagttcccttatttgtacaatggaaccattagttgctttggctgcccattgaaatcacctggaagagatttaaaagatacgggtgcctgagtcccacccccagaaagtctgatttaattgacctgggctgggccttggagcagagtttttaaaagctaccttagggaattttgatgagtagccaaggttgagaaccacaggtctagatcagtggttctcaaattggagtgggcatcagaatcccctagagggcttgttaaaacacaggttacagggccccaccccagagtttctgattcagcagtctggggtggggcctagaaatttgcatttctgacaagttcccaggtagggccgatgctgttggttttggaaatgcttctgtatatcaggggttggcaaactcaggtactccagcccaagcctgcccaccacctgtttttgtatggtccatgagttaagaattttttttttaacattttcaaatagttgaaagaatcaaaagaattatatttcatgacatatgaaaagtatgtgaaattaaaatttcagtgcccatagataaagttttattggaatgcagccatgcccattcagtctaccattagaccaagtgtgggacctcatgtaactgcacaggttgtatgcccaagaagctggctctgactgacattgactaatttaagctccaagcttgatgtgtttacctcctgaaggggatcagaatatgccaaccccaaatatgcctctttggcataataattattttgagctaaagtcaaatgaaaatcaacagctgtcggaagagttctctgccctccctctatctgcctaaaagcagaacatacatttccctttgaagaaggtgccccctgtaccagagagagaagaatgacttttatcatagaagatggggagttgataccaagaagagtttgtataaatagaccttagtccttattgttcattagttcccctatatatttcctagtcattttcccataatttattatcccttgaagcccaaaccctctttcctttgttaaaagggtatgttaaaagcccctgagtctagctgcttctttgtgttttgctccttttgtgtgaactcttgtgtatgtacttttttttctttttttgagacaaggtctctctctgttgcccaggctagagtgcagtgatgtgattatggctcactgcagcctcaatcaacctcccaggcccaagcaatcctcctacctcagcctccagagtagctgagactacaggtgcacaccaccatgcctggctaatttttaaattttttttgtagaggcagggtctccctatgctgctcaggctggtctcaaactcctgggctcaggcaatcctcccgccttggcctcccaaagtgctggaattacaggctagagcttccaaacacagccttgtacatgtaaatattgattaaaattgtgtgccttttctcctgttaatctatcttttgttagtttagtttgcaggcccccagggattgaacagaagaaggtagatgaaaagatttcctccccaatactcgttgcctaagaaatgtgagacattgttatttgcaggctcttcacctcactgttagtcatcccccatttccccctcccctacagcccacatcacatgacataactgcacgaaaggccactccattagacagagagaaagtctcttggaaacaggatgacttaagtcagatgacctcacaatagaaggattgtgggttattacaagaccctgtgccctttctggtaacaaatatccatgaaaggaccatcaaagatgcatatagagcaaaaattgcagaataatacctatgtgtatgctaaaagaaaatgctaagaaaaaaaatgataggcatgctgtgggcaggaagaacaggatggttgatatttatttctaaatatctgaaacccaaagttattccatggtattttaataaaagtcccatatgtaagaatcttttggtaataagaaagatatgaaaacacattttactggaaataagcatataagttgtaaagtttttaaaaagccccttctcctgaaccatgcctctagttaaatttaaatccaagtaatatcatccagttaactaatatggttttatctctgattctctggaaagatgtgtatccttcctggtaactattcccttaacaaagaggttgctatggatacatttttttttttttaaattgagtgctggcattttaaagcctgtgcaatttagtgcactatatctggccagagggttatactaatttaagtgcctgtatttaatgctagcaatttttatcttaatacacttgcttcatgcatttgacgtgccgtgttcaagagcgtaagagatggtgtgggtgttctttaaggaaaagcaagtaagacgaatatcgtacaacccacctaactgcaattgaatcagtggatgcttcactcgcctggaattcgtctgttcttggtgtgtttaataatgagtcatgcgatacatttgcaaggcaatggggccacctcccagggcctggggccacgttatgattttctgcgcctgagtcccccgtctttgttcagacaggttgctaatgcatcccgcgaagctgacctaatgctacttcagtgggtctatttttcttctgtggctcagctcgaatgtgatattcaggaagtcgactgtcaggcatgcaaattgagagaaaaatatgccacattaaatcatgatggtttaataaggtattactcatgggcaaatggcttctggtactctccttagtaggggcaagttgaaaagcataacctgccccagagaagagatctagcaatttcattgtcattccatctttgtcaaggcatttggtgaaatatgctccagttgacatactgtagctgccagtattctacctgaaaatataaacccacatgtatcctactttagtcaccaatattaagaatctttaccattatgattacacttgaggtgaaataccaaacatttcaaatgcttctaatgatagttccactctatgaatatgataccacttaggaatgtttcatggtatctcaagaattccttttcagagcaaaaggaaatctttacatttccatcttttactgcaaatagaaattaataaaataagtattcattttccttgcaactcaattgatttttctgtaatctgtagaaaatgagcatgttttctatatgccttctataagaatgcatacatttaaattataccttttccaatcagacatggaattttactaagaaaaaaaaagaataagtctagaatgaaagaattgtcatgctgaaattctccaggtcatttacacattgattactttgtctgctgcaaaactattaatttagtatttgccatggctttagaacttaagttctttacatagtaacttactttcataaatatggaagtataataattagggtggtgtatgtaacaataacataaaaacacttatttttgacaggctggtcattgtctgtcacagtcatgtcttcactcgtgaagattgaaagcaatgtcacatgaagaaactggtttcattcttcagttaacaatttaaatcagtgcttagttgtcccagactacaaaatatgttagaggcaacaaaaccatttttaatccttcttacctaactatagatattccatttaattttggatttgctttgttagatagagagaaaggagaaaggcaaagatttaaaaacataaaacagagggaacagcatgaaagcaactataaaatgctggcaaaatctggaagaatagaaaccatgtggaagtaagtattgtggaataaagatttaaaacccttcagaaatgttctttgaaaatccagcaacacagaggggaaaaatgaagaaaaattagccagtgccagtaagaaagcactttctctttccaccctgaccaattttcttttatttaaaagaaacagaacaagattaagagtttaaaaatagagaggagggcaaaacagtaatctgtagtttttttcttctttcagctgttcctctttaactataattaatcatcttctccaaacagcagacctccagggaactgcattgaggaaggaaaattcaaagcaatggaaacaaaatcagtccttacaggtttcaccgttgggatttggacccggagtgaaaagaggataatggtctcagagcagcctctggtggctgaatgtcaaaagctcaagaagtcagaggccaccttactagtgttctcttgacctccactctccacggtcttaagattttgtgcaaaggaagttactatttaaatgacttcaaggcactagttcagaattgattaggttggaattgaagtgaattcatcagtttcaagggcaatcacagatggactatggatttgatgctgacaaactgggccattccaacaatggggatatatatatatatatatatatatatatatatacaccactggtgactgacacctgaaattctaatttttaagcaatctgaatattttgattcttaaaacgctgtgtgtgtgtgtgtgtgtgtgtgtgcatgtgtgcacagagatctgtccatcagaagcatttggggtgcattttcttgtcacagctttcccagctgtacaacatctgtttaggacagaggcctatacattccatctggtatgttccccattgaaccatctcatctgggaagtttccaaggggcccttttcaaaatcttgagtcttataatctaacttgtatcaaatatcatgtccaaaagagtgctgcaatcttcagctccctttctatgagcatatcacatttacacatcaggttagaatgttttgttcaaaaacagatattctgtgttcaccaaaaaaaacttgaaggtttcaaacacagtgagggtaagtttgtgaatactcaaacacatattttaaattggtttcaataggagtctgctttatgtatttttttttttagtaattaaccagcagttctctgggcctgccagaggtgatggaattttgttaggaccacatggaccctacaaaagatctatggtatcaggagttcaagaccagcctgaccaacatggtgaaactccatctctactaaaaatacaaaaattagccaggcatggtggtgcacgcctgtaatcccagctactcaggaagctgaggcaggacaatcgcttgaacccaggaggcagaggttggagtgagccgagattgcaccactgtactccagcctgggtgacagagcaagactccatctaaaaaaaaaaaaaagaaagaaagaaagacctatgataacttgtgtgtacaatgttgaatttatagagcccacttcttattcacaaggaagtatcctggttcaatcaaatatcaacattagaattatctgggctcctaattaatgcctgaaaaagagacagcagctatttggaagtacaaggaattaatagtaatgtacagatgaacttcttagtctggacaaatgtgccaccattaggtaagatgttcataacaggggaggctgggggaaaggcatgcaggaactctctgtactacctttgcaactttctgtaaatcttaaaatgttccaaaatcaagagtttcttttttaaaaaaagtacagagagtaatgtcggcaaatacactcgggaagtgggaaaagatggacaaagttctctggcagaagaaaagtttaataacagtaggatattggccttgtcatccaagatggctgaataggaacagctccagtctgcagctcccagcatattccaactgaggtaccaggttcatctcattggggcttgtcagacagtgggtgcagcccacagagcagggcagggcgttgcctcacctgggaagcacaaggggttggggaattccctttcctagaaaagggaagccgtgacagacagcaactggaaaatcgggacactcccaccctaatactgtgcttttccaatggccttagcaaacggcacaccaggagattatatcctgcgcatggctcggagggtcccacacccacagagcctggctcactgctagcacagcaatctgagatcgaactgcaaggtggcagcgaggtggagggaggggcgtccgccattgctgaggcttgagaaggtgaacaaagctgccaggaagctcaaactgggtggagcccactgcagctcaaggaggcctgcctgcctctgtagactccacctctggggtcagggcatagctgaacaaaaggcagcagaaacttctgcagacttaaatgtccctgtctgacagctttgaagagagtagtgcttctcccagcatggagtttgagatctgagaacagacagactgcctcctcaagtgggtccctgacccccaagtagcctaactgggagacacatcccagtaagggccaactgacacctcatacagctgggtgcccctctgagatgaagcttccagaggaaggatcagatagcaaaatttgctgttctgcaacatttgctgttctgcagcctctgctggtgatacccaggcaaacagggcctggagtggacctccagcaaactccagcagacctgcagctgagagtcatgactgttagaaggaaaactaacaaagagaaaggacattcacaccaaaaccccatctgtacatcaccatcatcaaagaccaaaggtagataaaaccacaaagatggggagaaaccagagcagaaaagctgaaaattctaaaaaccagcacacgtcttctcctccaaaggaacgcaggtccttgccagcaatggaacaaagctggacagagaatgactttgacgagttgagagaagaaggcttcaggtgatcagtaataacaaacttctccgagctaaaggaggatgtttgaacccatcacaaagaagctaaaaaccttgcaaaaagatgagatgaatggctaactagaataaacagtgtagagaagtccttaaatgacctgactgagctgaaaaccatggcatgagaactacgtgatgcacgcacaagcttcagtagccaatttgatcaagtggaagaaagggtatcagtgattgaagatcaaatgagtgaaatgaagcgaaaagagaactttagagaaaaaagagtaaaaagaaatgaacaaagcctccaagaattatggcactatgtgaaaagaccaaatctacgtcggattggtgtgcctgaaagtgacggggagaatggaaccaagttggaaaacactcttcaggatattatccaggagaacctccccaacctagtgaggcaggccaacattcaaattcaggaaatacagagaatgccacaaagatactccttgagaagagcaattccaagacacataattgtcagattcaccatggtcgaaatgaaggaaaaaaatgttaagggcagccagagagaaaggtcgggttacccacaaagggaagcccatcagactaacagctgatctgtcggcagaaactctacaagccagaagggagtgagggccaatattcaacattcttgaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggagaggaacaacaggtaccagccacagcaaaaacatgccaaattgtaaagaccatcagtgctaggaagaaactgcatcaactaacgagcaaaataaccagctaatatcattatgacaggatcaaattcacacataacaatattaactttaaatgtaaatgagctaaatgctccaattaaaagacacagactggcaaattggataaagagtcaagacccatcagtgtgctgtattcaggagacccatctcatgtgcagagacacacataggctcaaaataaagggatggaagaagacctaccaagcaaatggggggcaaaaaaagcaggggttgcaatcctagtctctgataaaacagactttaaaccaacaaacatcaaaagggacaaagaaggccattacataatggtaaagggatcaattcaacaagcagagctaactgtcctaaatatatatgcacccaatacaggagcacccagattcataaagcaagtccttagagacctacaaagagacttagactcccacacaataataatgggagacgttaacaccccactgtcaacattagacaaatcaacaagacagaaagttaacaaggatatccaggaattgaactcagctctgcaccaagcggacctaatagacatctacagaactctccaccccaaatcaacagaatatacattcttctcagcaccacaccacacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactgcatggaaactgaacaacctgctcctgaatgactactgggtacataacgaaatgaaggcagaaataaagatgttctttgaaaccaatgagaacaaagacacaacataccagaatctctgggacacatttaagcagtgtgtagagggaaatttatagcactaaatgcccacaagagaaagcaggaaagatctaaaattgacaccccaacatcacaattaaaagaactagagaagcaagagcaaacacattcaaaagctagcagaaggcaagaaataactaagatcagagcagaactgaagaactaagatagagacacaaaaaaactcttcaaaaaatcaatgaatccaggagctggttttttgaaaagatcaacaaaattgatagactgctagcaagattaataaagaagaaaagagagaagaatcaaatagacacaataaaaaatgataaaggggatatcaccaccgatcccacagaaatacaaacaaccatcagagaatactataaacacctctacacaaataaactagaaaatctagaagaaatggacaaattcctggacacatacatcctcccaagactaaaccaggaagaagttgaatccctgaatagaccaatgacaggttctgaaattgaggcaataagtagcctaccaaccaaaaaagtcaaggaccagacagattcacagtcaaattctaccagaggtacaaagaggagctagtaccattccttctgaaactattccaatcaatagaaaaagaaggaatcctccctagttcattttataaggccaacatcatcctgataccaaagcctggcagagacacaacaaaaaaagagaattttagaccaatatccctgatgaacattgatgcaaaaatcctcaataaaatactggcaaaccaaatccagcagcacatcaaaacgtttatccaccgcgatcaagttggcttcatccctgggatgcaaggctggttcaacatacacaaatcagtaaacgtaatccatcatataaacagaaccaaagacaaaaaccacatgattatctcaatagatgcagaaaaggccttcgacaaaattcaacaacacttcatgctaaaaactctcaataaactaggtattgatggaatgtatctcaaaatagtaagagctatttatgacaaacttacagccaatatcatactgaatgggcaaaaactggacgcattccctttgaaaactggcacaagacagggatgccctctctcaccactcctattcaacacagtgttggaagttctggccagggcaatcaggcaggagaaagaaataaagggtattcaattaggaaaagaggaagtcaaattgtccctctttgcagatgacatgactgtatatttagaaaatcccatcgtctcagcccaaaatctccttaagctgataagcaacttcagcaaagtctcaggataaaaaatcaatgtgcaaaaatcacaagcattcctacacagcaataacagacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatattgtgaaaatggccgtactacccaaggtaatttatagattcaatgccatccccatcaagctatcaatgactttcttcacagaattggaaaaaactactttaaagttcatatggaaccaaaaatgagcccacattgctaagacaatcctaagccaaaagaacaaagctggaggcatcacgctacctgacttcaaactatactacaagtttacagtaaccaaaacagcatgatactggtaccaaaacagagatatagaccaatggaacagaacagagccctcagaaataataccacacatctacaaccatctgatctttgacaaacctgacaaaaacaagaaatggggaaaagattccccatttaataaatggtgttgggaaaactggctagccatatgtagaaagctgaaactggataccttccttacatcttatacaaaaattaattcaagatggattaaagacttaaatgtaagacctaaaaccataaaaaccctagaagaaaacctaggcaataccattcagaacgtaggcatgggcagggacttcatgtctaaaacaccaaaagcaatggcaacaaaagccaaaaatgacaaatgggatctaattaaactaaagagcttctgcacagcaaaagaaactaccatcagagtgaacaggcaacctacagaatgggagaaaatttttacaatctacccatctgacaaagggctaatatccagaatctacaaagaacttaaacaaatttacaagaaaaaatcaaacagccccatcaaaaagtgggcaaaggatatgaacagacacttctcaaaagaagacatttatgcagccaacagacacgtgaaaaaatgctcatcatcactggccatcagagaaatgcaaatcaaaaccacaatgagataccatctcacaccagttacaatggcgatcattaaaaagtcaggaaacaacaggtgctggagagcatgtggagaaataggaacggttggtgggactgtcaactagttcaaccattgtggaagtcagtgtagcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacaaggatgaagctggaaaccatcattctgagcaaactatcacaaggacagaaaaccaaacaccatatgttctcactcataggtgggaattgaacaatgagaacacttggacacagggtggggaacatcacacaccggggcctgttgtggggttgggggagggaggagggatagcattaggagatataccttatgtaaataatgagttaatgggtgcagcacaccaacctggcacgtgtatacatatgtaacaaacctgcacgttgtgcacatgtaccctagaacttaaagtataataaaaataataaaaaaacagtaggttattaatcactgttgtttgttatgtaccaggcacttaactacacaccttaactacagaaactaaattaaattgtgccctttaaatgcattgataaaggaatattattacctgctctcattaaaaaaaagaaccaattcataagaaaacaagtccagaagtgtggtgcttaaatttcagtaggagaccttcattcctccttcctctcagccatctccctattttatccgtccctaggatcttcggcccctccaaaccctgtctttattggttcccaccacgacatttctttttcattattcatatgtttgagtatcagaataaatattctgatactcaaatatttgaattttgagatcattacaggtattagtttttcatatgaaaaagcaaggggcagttgatgtgctgatggcaacacaagaatcctagttagaacagacctcggtctggccatgaagttccattgtgaattctctggacttgatcagttctttagcacttttcaagcaacctaattagtatctcagctattcttagctccagaacagggtccaaagttcccatgatgacagtcatgtggcaaaatttccaagtgtgacacaaaaacattactccttttcaaactcagaaagtgtaagaagcacagattacaagcagaaagagtatgtatccaaagcccagtttccttttaaacctctcttgtcttctttttaattccactgggacttttattgatcctgttctttcttgcatttgctgctttgtcattgccgtgattgaagtcagacatcttttgaacttcttcctaaatgttgtaggtgcgacagcatggcactttgttctcaagcttttctaccatagtggtaagtacagttagttgagccggggcagtgcaacatggctgaaagtccaagtgaacagggggtcaggagggctctcttcaattttctctgtcaccagcatgctttgtgtcctggggcaacctatgtaacttctcagggtctccaagtcctgaggtgggtagtgttaaaagaaaaactttagctgaattaaatttaagagtttaatggagcaaaggatgattctcaaatcaggtagcctcctgaagctcagagactccagtgcagccacatggtaagatttatggacagaaaaaggaaagtgacatacagaaaacggaaatgacttacagaaacagctgaattggtcacagctcagttttgtcttatttgaacatggtttgaacagttggtcacctttgattggccaaaacttagtggttggtgcaagagtagactacagtctctttacaactccatttaggtgatagttcatgatatacagagaaacctttaggtcgagcttaaaatatgtaaggaggcagctttaggctaaacttgatttaacagtagtgaggggctgggctttgtgcagataaaccactagggtttactaagcaccctattggacacctcttaagtaccacatcaaggcttctagttgccaactcttcctccagccactgctgtggtgacagtttctatgttggctttaaccagtttcccttgggtgcagtctgacagtgtcttgcccctggttgtaccaaggacctcttgattcctaccttgaggcttttctgacagggcaaaggaaacccatccctcaactctcctggattggcaacccagatgtacagggagttgactttcatggggccacccaagatggatgggccacaggagcctcttttccctcagaacaggggagttctgagacagatttgataagctcctcagaacactccctgggatgaacctcagttgtccataggagaagccaagttggtaatgcccttgtctgggctttacagctgtgttttactctcctcgccaccactccccgaaccacactgccactccctgagaccacctcccatacaaacttcctctaaggaagccttgcttcaagatctgctgtgggcagacacaggctaagacaagcacctactccatatcagacatcttcatcctttcccgctttaaatgttgatgggtgtgcaattgcttgctggcagagttcaattctgcccagtggtccttgtaataagaacagactgggaagaagctgagtggccaggataactgaaaattacttccagctttttgcctgacttcaagaggccaccgggtataagactctggtatagtcccagggtatatttggctatatcacacagcaacctaatataagtggaaaggaggtataacagagagtaatttaaacagaaataggctaatgagaaagaccccaaaactgttcttctctctttccaccccctgatgttaaggaaaaccataggggaaggaaattttcgcctccatttctgctcaatacagaagttttaaagttcaggagaaaaatgtctgagaagcacatttttgcatgttgcccaaaatgagggaagtgtgccatttctccctttagaacacagccaagggacattaataatggttagggggaaaaagagtattctttgtcaattaggtttggaaaataagttaagtaatcttttataaaataaatggcaaattttctctgagccttgaaaatagtaacatatattgtgattctttgagagggaggctgagaaaacagcatttacctaatttattttttgacctaaccatttttccacaggccattttgcagaaaaagaaggtgtgaaacaggaatttttctaattatatcagagaaacgaaaagaaggctgtcttttttgcttgattttaacaatatcttaattggaggatgtaataggtaaacactcaaggctgcttctctcactatgatcctgatacagtacttgtggcataagatatacaaatgaccaaatctttttatggtgaattagggtatatatggcattgctccatctcacccacacctctcaagctacacaaccatccaggaggtaggtgtaacaggaacctttactctttgatagagaaaacagttcagtgttcacctatatttaagtgatgggggaggcagagccaggaaatcagatctatgtcttccagctcccgatccagcattgttaccaccaccacatctatattttgacatttttattagtttatttatttagcatcccattctatagaaggggaattgctttttatttctagttgtgatttgatctttccccaatactactcccacaaaatgaaacatatgaggttgagaagggtcaacatcactgctggaaaactattaagagtattgtgtgcctttcaactctaacttcaaatggagaattagactctagaagggttaatattaaagagtgctaaaaattaaaaataaaaaaccctgaaaaaataacatgatattttgaaaatggaagaataaagggcatattctgctcacagtgccacaaataagtaagttatctatttgggggttagtagtgggttgagatgtacctgattccacgtgtccctagcatgtagtgagccaactcagaacaataccagccctttgtgtgggaaagcatggaaaatgcagtcatcgccattcaagtgtggtttagggtgaaatctctgagcgtcagaatcatcatatacgtaggtaaaagaagagcagaactaccacaaattacccagaataagaatttttcatttctcattttaggcatttcctccaggtatcaaaattaaattttgctttcatcttatacacatcactgtatgactaccatctttatgaaaaaggaatacacaaaattcctcaataatctccagccacaggctccaactgttccagttctgactttttaaaaccatcacctctggcagaaaaatatgagattccactgccataaatccagttttcacagatttcatatatgtacacatgaacaccaacagtaagaaagatttccacgaagctttcctctatctgtatattttagtatgtattttcgtagctatggtgttgttacaatgccccagtgactgtgaacttggataagtcttgctgaggatggcagagtggaaaacagagacacaccaggattcttgatgacatcattatgccaaagaagtagtcaactgtggaactgtgtttgaatttgtgtgtctctctctgtgtgcgtgtgtgtgtgttttaaggaaatctgtgtttttaaagccactataatcaactaactaaaacatgcaatccaaaactctgcattatgatactttgaaatattttttaacgcattcacaggccaaacaatattgtgagaaagcaaatttatttcagaccaataaaagaagaagatgagtgatgccaggagagaaaaactccttaacatatgtgatcttccttttcttcatttgctaaatagaatctaagatatatctacctcattgagatcgtaagtccatagtaaggattcattatttgactattttattttgcattagaaagtgtggcagagacaatgttatatgtccagtaactcctgttacattttgtttttcttcctgggcacacgggaagaccattatttcccagcttcccgtgttgttaggctgtgatcatgtgactgagatctgagctgtgggaaaaagtgatgaaagccacatgtggcctggtttttattactgttgcacatgatcctctgccttctttcctggtgtcatgttactattacgtttgaatatgaaggtctaaccactacaagcaggagatcaagccttcatattggccactatatagacattgagtagttttattttattaaaatattgaagatttccttaagttcacaactttgttcatgctttttcacacatgcttcttgctttccctttaaaaaggaaatataaattaataattaggaaagctagctcaaaacctatattaaaataagtatggggaaatggctttaaaatatcagataaagtttacaaaaatctataggcaaattttctccatagaagcaaagcagctactcctagcagtacaaatgaggcccctctaagtaggtgcatgtaagtgggtattatacatgcctaaacatctactaaagagaaagcccattaagaaaatgatgtctggaggcacctacatctttttcccctttttcaagtacagcctagacatcttatcttctgcagcttttaacacaatctctgcatttccattccatctggcggggctggttgaagggaagatgtgagaatatgctgaaggagaaatctacctctccttctagttggatcacattacaacatgtgagcaagcaaaatgtgtgtgcccactaacgtcagcatggttttcgttttgtgaatcatatcatgtttatagcaacctcttctttttgtaagcaggcacaataacagaattgcaatttgtatccatctaagtaagaaaataagcaatgaaaatcatttctataaaagaaacctagaagataaagaagtctctagcgtttttcaaaggaccctagctaccattataatttttaatatgaaccgtgcaatgtggaatactgttgatttggcatggggaatgatcttcaaactttagtttgttgaaaaataatgtatgtgttcatttgaattctgatcttatatttcacttaaaacagtgctcacatatgaatttattgattttggcatagcttaactttgaaaatattaatttttgaacacttaacgtgtcaatctgactgtaatatttaaaagaaaaagtcttgttcagtaatagtatgtactttataactttaaaaagtatatgaaaataaactgataggttgtagataagaacacagaaactgcattcatatttaagataagattatgaaaacaaaagagttcaaagaaaattcacaggagacatataactcctgtcacttggggataaaaagccacatctctctgttgataagggaacctcagtggaaagttttgaaaagtactgttcgaattatttggtcaggtcacttatctctagcttgattttaaccttggagcacaaggaacttccccaaaatatggctccctggtataatgagtatttcgaattaaaggcctttagaaatcaacagataaaagaagagagctccccgccatctacataaggattggacagacccaccaagaagaacaattacttctccctccccgcaacttgcccctcccatctctgaatcctctatctctcccaaagcacaggctgaagttgttctctaaagtttcagcctaaagtccggacctaacaaagaagaaaacaattacctctggtccctcccctgagttttcattattgcaggaaggaaggctgaagtctattaacaaacctggacagattttgtcacaaaccattgtctgctctgcaggcccaacaaactttgttccagaccattgtatgttcttcaagcccattgaatctccctaaaaataatttactaatccctaaaatcatccacacttccccatctcccgctctcctaagaagcagggtgtataagcatctgtaccctgttgggatattgggcattcagtctgtgattgtccccctgcccacggtagtaatacctttatatggcttttctcttaatctccctttttgtgagttgatttttcaacaaaccttccaagggcgaagggaaagctttccctttgcccctacaaccttgagagtttcatgtctaagtgggggttcttgaacacatccagggacagaaaactcattctctcccttgcaatccccttatagctggacagctctaaaagttagtagatgtgttagtcagggtaagtgaatctagctgcacaagaaaagatcccccacatctacatggcttgacacaataaaggtttatttaatgttcatatcacaatgcaccaggcagttctgctcagctggctcttttcgcagatcttggcttctttcacctaccatcttacaggacctcagagtcctccccaggaccctctgcatctgactagcagcaggggaacagagaatatgtggaagagctcagagggggctttagaggtcaggactggaagtagcatatactaagctcacccatactttattggcttgactgacataggcacatggccccacttagatagcaaggggttaaaatatatagactatcagggtaaccaagatggagatgagttcacagatgttggagagtactagcagtgtctgttatggaaaactgtccttccattgagctaaggtgtttcttgcagtagtttctacctatagaacccagcttaactttgggtcacattgaccaagtttaattctgctttcatatgacagccccacagatatttgaagacagtcattatgcctctacgtctacttgcttctgggctattcatccaattagtcaacttgttctcatatcatcagttttcacatcccctcatgatttgtttgtttgttttttgagacagggtctcgctctgttgtccaggctggagtgcattggcacgataatggctcactgcagcctccaccttctgggttcaagtgatcctcccatctcagcctcctgagtagctggggctataggcacatgccaccacatccagctaattaaaattttttttcagtaaaggcggggtcccaccatgttgcccaggttagtcttgctctcctgggctcaagtcatcctcccacttctgcctcccaatgtgctcggattacaggtgtgagccactgtgccaggtcattttttgttttcctaagctccaattgctttacagtttgaatgaaaactgaatgagatactccaatagtgaccccagcttgagatattgtaaatttattactacaaattaccatattaggttctgttaattcatattgaacttactccttctaaatgatttagctaatttggctgctaagctacattttcttcctttttgcacttagtttattactggaagtcttgatattttcttcatttcattttgttgaatttgaataccatcactagctgaattataatacttcagctcgtgtctgtcccatctctggccctgtaaacagatgtgcccatacctaaaagagagggcatttaagagccaaccataaggaccaccagatgctcagatcagaatctttgtagttatccatggttttttgttgttgttgttttttctgtctctcaaatccagcatccaatcttataagaaaatcctgttgacttcaccttgaaaacacacccagaatctgatggcctctcttcctgtccttctgcttcatcttttgattgcattactgctggagcctcttctgggtgcttgctcctaccttgcattcccctgcactccttcccagcctatttcaaagctgtcattcttttgaactcttctgctcaagactcttcgttggctcccatttcacaagagtaaaagacaaagtccacgcaatgctcccaaagctctaagaggctgtccttgctgtgacctagtcctctcccagttgcccctgactcccgctgccctcaccactctgaggccccgtcagttcttcacagacgccacaggctcccatctcaggcctttgcacttgctgttctttctgcccatagttcttgcctccaggatatcagcatgatttgcactcttagtttcttcaggtgtctgctcaattcttaacctctcccaaaaggccttcctagacaccttacacgaaagggtaacctccttgctcctctcctttgtggagggccttggttcctgtatatcctgctttatttgtatttgcagcacccctcactagctgacagtgattggtttattgtccatctccctccattagaatataaactgaacaagggcagggactcatttaattgacttttgtggcctcagcatccagaatagcactagatgtgctgctggtgctcaataaagattggctgaagaaggcacagatgctttactgtccccagcttcctgcttcccccagcttcatacacttccccgtagcttcctatgctctttgcagagacagatcatcccctggttcctaaatttgtatttcaaagtattagctgctttcctagctttatgtgttacccttcaaatgtgtagattaatgagtaaaatgtagcttcattaaggcatgaactagttgagactctaagttaacttgggcaaaaccagttcagcaattcccatgtcttgtcttgtatttctgcctctcgacttagaaataaactctggtgcggtaaccaaagttctctccaagacaatattgtccacactgggtgttgttaatgctaaaatcatccacagcacatttctcagaaaacatctgctcttaataattggggatgaggtctgtgcctccttaaactttcctatacatcattggtcaaaaaggtagaaataaaaacctgtatttcttaaaacaaggaaaacattgcttttctaatgaaaactcaaagagttgaaatatgaaaaataaaaatcccctcaaatttgaaaacataacaaaatttaattattttgttgatggaggttaaaaaacattgataagttttatggccttttgccgaaatctatcatcacttttggaaaacaaaactcttcccagcaatacctttaaaggctgtgcttcacaggaatgcaaaagaaaattgccaaaagattacattgtataatttgtccctgccaagcattctacttgaataacagaaaattctaccaagattttaatagaactgttctttagcttcagttaactaaacccctctgtgaaacattagaaagatgtatgcatcatttctatgtttattcagacaacaaatatttataggcagcttgctttatacacaggatttgaaaagagaagatttttcacagcagagatagtcctggcaaagacggaattccagctgggtcaactgaatctttaactagggcatctagatatagagatactaatatagttatagttatatataaatatagcagcaagcaaaataaatttggtcttattctataagtttattcatgtacttcctctacctcgagaatataatttaaatattacagaaaacacttctgtcctgagaagaactttccctccaaatagcattagctagttttgctttccctggtaattcagttattcattcaagaacaatttatggcagtgatgccccaacccttttggcgccagggaccggtttcatggaagacaatttttccatgaatccgggatgggtgggaggaaggtggtctcaggatgaaactgttccacttcagatcatcaagcgttagattaccataaggagtgggcaacctagatccctcgcatgcacggttcacaataaggtttgcgctcctatgagagtctaatgccgccgctgatctgacaagagagagagctcaggcgataatgctcactcactggccactcatctcctactgtgtagcctggttcctaacaagccacagactgggaccggtactagtccatggcctggggacttgggggcccctgatttatgggactcccacacatgccagagtgggcaaggcactggagatgtgaaaatgcacaaaaccctcaaaaacccacagtgcagtggggactggagggacaaagggtgacattaggagcatgtgctacagaaaactcagcctgattcattcagtaattccacaaatattgattgagtgcctgctgtatacactggtctagatgcttgagacacaccagtgaaataaactgacaaaaaactctgcctttgatgtgcttgcatagcaggatataaaaacgatagacaagaaacacaacgaacaaggaaattacataatatcttagaggataagccctatggggaaataaatcaaattttccttcaagttggacagcggaagaatggatatgcaagacctcaaaaaagttgccttccatgtaacattttccagtatgtgttccagaaaaaaatgaaagagaaaaccaagaaagagaaaaaatggaatctaggaaacacaagaattaagccagagaaaggcaaagaaaacatgggaggaacagttcttcccccttcctctcccatcatctgggttgaatatgagccaccagtatcatcccccagtatgcaagccaggccaataagctttagttgcaggattttctaaattgggcctgacagaagagagtactttcctctcaggttatgatgcagtgaggatgtgatcccaagagctaaaagtgacccggacctcctgccttatgaagacagctcacccatgagactgaagttggtagagagaaagaatagaaacaggaagaagcagacaggtcattctaccattgtattcctgtttctgtgcagcttcaaatgccctctgatagtagatcacatgaattggtcacaaattatgtcaacaagtgaaatctacccactctttgaatctgggtgtggccacatgactcttattggtcaatgggacattagcaaacacgaagcaagcagaggctaaaaagtgtttgtggtttggggcttgtgctcgctggccgctgggaacctttcattaatatataaagtgggccagactggccacctggaggatgagagatgaggtggagcagcgattgatcatgtagatcatgtagaagcatctcagctggtgttttctagatccaccagccctctcatcacctgccagctgactgcagacacatgagtgaccccaagtgagccaagcagaagaattgcccagctgaatccagctaattgctgacccacagaatcatagctaaagattattgttttaagccactaaattttatgatggtttgttatgcagcgctggataactgatacactctacacacacacatgcacacactacacacactttatattttttcttaaagtaaaacaattttttgccatttgcaatcaaaagaagttctaactaaaatcatagagcttcttgtgcttgtgtcattgacttggtgccctgttcattaatttagttattctgtgacttgaactatgcccctgaattccaagcttctccttccaatctcaatgttgacattatccacctgtgctttgtccaggataaagacactaccgtttgtggataaacaaactacaaaagaaccttctcctccctcctcttcaatgcccacacctgtcaggttggcccccttcctatggccttttgccaagggtctgtactgccacttcctgttggctcttttcaatgccaacagcttgacaatgtgactctccatctgtcactaattgctggacctactgtcatccctcttcacttgtctgtgcagacttcactccctcctgcaaataggagagctatccacctgccaaatgccaacagtcagtttccagcctagatctgaaccctttctggcctattctgtttcgttagattgagattcccatacgattactcttccagtttatcctctgtctgggttagagctgggtctgggaaggtaagtgaatctctttaagctctcatattcagatgacaaatcacatacagtagaagtagatggtgattttttttaaaaaaaaaaacaagccatgggaaaactattctcttcctcgtggaagaatattgacaaggctcttgcaggcacccgtggagtctgtttattgcctttggggttgtagacaatgaaattgattctcaatatcaaccagataggtcaattctctgctcatattcccttaggcctttccatttctatgcccagtagcctgacatccaactgccagtctctacaatttttttaccagagagttttctctggtgctggagccagctttgcttgcatatggcagcccagaagtgctggagaattaatgtctcccacttctaccactgtgcagtcctcatgcagtgactggccagaattggtgtattaatacccccgctcccttgtccctcagataggatatctctgaggagtatgttttccactggatctcagagttccccaataagattaagcttcagtgcccacagtggtaacttacctgataacctattctttattggttttcctctcttccttgtctctctcccccaaataaattacatgcccttgaaattttgtctcaaggtctgcatccaagagaacccaaaccaagataataatccacccagtaactgaatactctataggacaggagctggatctatggagatggtaacaatttaaaaggaaaaacagcacaataatatgatgatgatcagaaccagccacttagatggtgagcaaaatcagtgttgctaccaggccccatttgccctctatcttagtcttgggtgaccttcctgatagtagagtatgtgaaccaaggatgaatataagggaaatttttggttataacctgattaatccatgggtgtgggcatcagtcactttgcccaatatccacagggcaataaacttgtggaatttaatttttttgtaatgtgtgactatttaaacattattttacagatttttatgggagaatgatactctgatatggttcttcgtccaaaagcaaagtacaacttaaaagataaccagcgggacttccaatagctatgttcaaatatttatgaaacattgacttttgggttgtaggctaaagcacagagtttaaattggttagttctattgccaaatgccttcagacttcattgacttttttggaattagtacagaagcagagattagatccaaaacttttacagagattctgtgtggtccagaaaattatgagtctttgcttgtacatagaaattaaatattacacatgtttacactccatcttttgagacagtgagcaattgaggcgtctgaactgattgaagaaagacctctctataaatctatgacctattattcttctaccaaagagtggaaaaattcttaatagttctgaatgatgaactttcttaaaaaattgggaattttggcatctgggaggcaatgctaaccatttgaatagggcttcctttactttcagtcagtattgcagtcattgctttgtcaagggttctgagatccctcaagcatgaaaggaaggataaggaatcaaatcctttctctacttaatagggaatgtctcagaactgcttcaaaattagctttggctcagcttaatgaaatttccccattgttgagcagcggcccacaaaatccacagcattaaaatggcagtccttcaactgtaaaaaaaaaaaaaaaaaaaaaaaaaaaaaaaaaaaagccttgaaaattacagaacatacaaaaataaagatttttatttctcttccccaggttcacagaaagaactgaacctgctcagccttttgagtaggctaaatattagaggcactccaactcaggaggacgtgttttactcgcacaatttaacccataaaatgcctatgatagaggactcgaagtttctgcaatgaaactcaccagccctgctgccctcaggaaatcattttagaggacagcagagcaaccaagagacatgagagggagctactcctcactggtgttgcttaagtttctccagtggggtcttattcagaaggtgtttctcttgagacttctccccagctctggttaaattaatttggctttactggactgagataagataattataattgcttctctatcccctttccttttcactttgcacccacacacaatctttgtgttttcaaaactccttaaaatatcactataatatatgacatcaatttctttatattaacatgtgcataaaatttgacactcagtgctcacctttcatcactcagtatctactcatctccctttgcctgaacaagggtgcatccaaacttacagtctttggagcacaaatcaatgtagcaatgtagccaacaaaggatctcttgattcaaatgataccaatgtcaaatgctgatgtgtgtaaataattaattgtgttttcactggtgagtccagtttgatctttcattgcttggcgacccctggggtctgtggctccctgagaagcaggaacatttaggattttttattaccagctcatcaataatttatagattactatggagtcaggtgcacagattcagagtatcatctatcactataggcagctccagtgttaagggatggctacttcccagaaatcaacgaaggggaacagatgaggaaagggggcaacatggcacatatgccacagaaggcacatctttcagaaacacaaacatatcaaggtaaacaatttccttctcactgagccagacaaactataaagtgctctaactatcccctaaaggtaaaacaccactgtatgttacatagccaaatataattcaactgttatcacttatcattaaaattatttatgtttttcttctcttctatgctgtcttaggtgaaagtttcactagaacaactcttagattcaaacttgtagaaagcgctattgcttaaaaaaggggggtgggggaggatgggtactttcttaacgggaaaattgtgtcttgccagaaaatgaccttgaaattagagggaggtattggagtttaatcacagctttgataacgtatgtgctgtgtcttttggacaatgccattgagtgtggggttcatgtccttatgattgtctaaagtgtgtcacagtacatgcacatgttgtgatggaaagaagcaaaatgtacaaacaataaaagggccatttattacagaccttcaaggaaaccaacaatgactttgggatgtatgttgcattcctgaattttacatgattttctggatagcattaacagttttctgagaatgttcttaagaattccatttctatcacagccatgtatgtattcccaccctctgaccccacagtcgtgtctctcccaacttctccccaaagctggttctcacagagcaaaggaaagatgggctgtgcaaataaaacctaaacccaatggaatttgaaacaagtcctagtaggataaagaaatctctgaacatattcataaggagtgtttctttagggaacttttctgtttcagggacaccactgaggctgtgccacattctgaaactgttgctatggcaaagcgtcttgtgttattgacgatggagcacattgttgtgtttaagtcatgtaaatgatcaggacacaaaggaagctgcccacagcagcccctgctcaatcaccacagcgctggggcctttcccccttgacacatgccatttacacggcatgggaaggcatttctttcagaaagcctcactccctgggtgctgtgaactgttctttggagacgtttatgagatctccacatctttcagaatcgattctgcaggggaaaaagaatacacaatgacaaagccctttcttttgttttaaggtcaggatatttctatagacattttgcattttctacctattaacacatttttttttccgggctgctggtcttgtctaatatttcaactttctatcagttcttgtcatttagagtccaactatgagagtttctcctttgtttcccacttatagctcaaatatgtgtttttaattattttccacagcatcaattcacactgattagacataattacagaaacaaaatatgcagaatacattttaataatgcctgtcacctctgagggaacaatgaggatctaatttaatgatctaagtgttgtttgaaagcgacacagagtttttaaaaatagtactatatattttgaagtggagcttattagtatttttagatacaaatgtaagctgaaatgaactattattcaggtttcaatgcatgtaattaaaaaaacacttagggcaatgcttgtttacacaaagaatcaaattataccctttaataataaaagcttgatccaactgtgacacttgagacttgaaatgatgtgataatttgtagtccaatttctaagggaaattttgccatatgaaaatctatttttgacaatactgtgtcaaagtcaatgtcctggttttgacattactgtggttatgaaagatgttttcattgggggaagccgcatgaatggtacgggggaactctctgcattagttttgcaaactcttgtgtgtctccaactatttcttttttttttttgagatggagtctcgctctgctgcccaggctggagtgcagtggtgcgatctcggctcactgcaaactctaccttctgggttcacaccattctcctgcctcagcctcccgagtagctgggactacaggcacccaccaccacacccagctgattttttgtatatttagcagagacggggtttccaccgtgttagccaggatggtctcaatctcctgacctcgtgatccacccacttcggcctcccaaagtgctgggattacaggcatgagccaccgcacccggcattgtgtctccaactatttcataataaaaaaagttatatcaaaaatctatttttcatacctaataaaaatatattttttctacttgtagaagaatatgctgtctcagtagagcttagaatattactattacagaaccatatgacattactctcaatatttgtcttggcatctggagtcaaaggaattttagacaatgagttaactttctcaaagaaaatctctttaccccgaattttcaacttgttcagaaaagaatttgtaaacagttatgaatgagaaatctacttacttttactgtttcagacgctcttctagaagttattaaaacagtatttacaattctcataaatctggaggcataattggatctcatttcctttgcctttttcgctctttttaaaaactcttttggctcggtgtggtggctcacgcctgtaatcccagcactttgggaggccgaggtgggcagatcacctgaggtcaggagtttgagaccagcctgaccaacagggagaaactccatctctactaaaaatacaaaattagctgggcatggtggcgcatgcctgtaatcctagcttctcaggaggctgaggcaggagaatctcttgaaccggggaggcggaggttgtggtgagccgagatcacaccattgcactccagcctgggcaacaagagccaaacactgtctcaaaacaaacaaacaaagaaacaaacagatacacacacaaaacaagcaaacaaacaaaaaccctcttttaactccatagttaaaaccatagttttgcattcctagctgtcatgagtgaagctgagatttaaaaaagtaatataggactatcacaaaccaaagttacatctaacataaatgtccattcatatttcatttggctgtgattgtgtatttgtggcatgtatatcggtgtgtagggaggatgcgtgtgtactcatacaatgttaggatcggcaggaccataggaatctcctaattcaagctcaatattaacatattcaatatacataggttcgatatttataatatatactgctgattgtgcaataattcttcacattcccatggccttctttaagaggtcatcatagcacacatctaattttatcctaacataattctacgagcttgctagagggcattattattattctactgagaaaatgggcagctaattccaaagaggtccagctttggctcagtcttacacggcatgtgaatggtgaggttgaggattaaaacccagattccacatccttgctcagagtacttcattctggcccacaatctctaaagctacaactgtctaaatacactgtctacactgtcttgtataatatctgaaacagtgcatgttggagggagagttctattaaaatgataataggagttagttaattctttttaaactgtaacaattaaaagcattttgtgagtgacctaggaacacggctctgtatcataacccctttctcttttctttttttttaaagtttagttgagatacaattcacataccacacaatgtacccatctaatgtggacaatttaatgttttaaagtatattcccagtgtcctacaaccatcatcaacatctaattttagaacagctttatccccccaataaaagaaatgctgtgcccattagcagtcactccctttccccctacccttcacccctagccccttgcaaccactaattgactttctatctctatgaatttgcctattctggacatttcacataaatggaatcctacaatatgtgatcctctgtgactgccttctttctctgagcatgatgtagcatgtatcagcagctgaataatactttttagagctgaatactatccggttgtacggaaatgcatggatatcctgcatttgtttttttgtttgttttttgtttgtttgtttgtatttagacagttgtagctttagagattgtgggccagaatgaagtactctgagcaaggatgtggaatctgggttttaatcctcaacctcaccattcacatgccgtgtaagactgagccaaagctggacctctttggaattagctgcccattttctcagtagaataataataatgccctctagcaagctcgtagaattatgttaggataaaattagatgtgtgctatgatggcctcttaaagaaggccatgggaatgtgaagaattattgcacaatcagcagtatatattataaatatcaaacctatgtatattgaatgtgttaatattgagcttgaattaggagattcctatggtcctgttgatgctaacattgtatgagtatacacgcatcctccctacacacccatatacatgccacaaatacacaatcacagccaaatgaaatatgaatggacatttatgttagatgtaactttggtttgtgatagtcctatattacttttttaaatctcagcttcactcatgacagctaggaatgcaaaactatggttttaactatggagttaaaagagggtttttgtttgtttgcttgttttgtgtgtgtatctgtttgtttctttgtttgtttgttttgagacagtgtttggctcttgttgcccaggctggagtgcaatggtgtgatctcggctcaccacaacctccacctcccgggttcaagcgattctcctgcctcagcctcctgagaagctaggattacagtcatgtaccaccatgtccagctatttttatttttttgtatttttagtagagatggtggtttcaccatgttggccagggtggactcaaactcctgacctcaaatgatccacctgcctcggcctcccaaagtgctaggattataggcatgagccaccacgcccagcaatatgctacgttttatttatccattcatccactgataaacatttgcgctgtttccactttttggctattgtaaataatgctgctatgaacattcatatacatgttgttgtgtgaacatatgttttcatttctcttggatatatacctaaaagtacactcgttggatcatatggtaaccttatgtttaactttttgaggaactgccaaaccatttccaaagtgactgcaccatatttcatttccactaataatccttttcttaacttgagctggtaaagcctccgtgatggctcctggtagttactaaactaaccatcaaagtcctttcttgcacacacttctgggtctggtcaggtgaaaagtgggagagtgtatttgcctcacatgatttcagaaaagccatcagaaattagaatgggaaacaaggagattaaggatatgcatattaattaaacatctagaatgtaagttatttattggtgaggaaatttaaaactttaagttgcatcaaatacacacacacaattcaagcggccatacaaaaataaaaaacaaaccaaatcaaccaaccagtcaaacagagattcacaacatcatccttggcatttgatcttccatctgtagcccctgaagtagtgcaacaatatgagatatttgaaccgtttttgtagctcttaatagcaagagatatttttggctatgaagacatctaggtcaaagccctcacacttgcttcttgctcacagatgtacaactatttcaaaaaaatctccaaaaccatatgaataaaccttttataatcttaaggattcttaagcctctagacagagattgatacagaccctgacttttaaagcaagctgggacaccttctggaattcaaaacacatgcttggcccctgacaagtcaagctagagtctggaggtgaattcggctggttcttttacacacgaacctcgcaacactctgactagctctttttgtgtggccagaaaggtcttgaggcttcgaggctgcaaacagttcctgacctgtcactgctagactcaaatagccactttttttttttttttttgagacagattcttgctttgtcgcccaggctggagtgtagtggtgcaatcctagctcactgcagccttgatctcctgggctcaagcaatcctcccacctcagtctccggagtagatgggactgcaggcacacgccaccacacccagctaattttcttattttctgtagagacgaggtcttgccatattgcttgggctggtctcaaactcctgggctcaagtgatccacccacctcggcctcccaaagtgccaggattataggcgtgagccaccccgcctggccaagtagccatcttcacttctttgccctgatgtttattatatccatcagtcagcacttttgacttgcttttttctgtgacacacgtgacctgatttcagctaggtcagtacaaagccaaaaaggaaaattgtttgggatgtttctcttattccattgtctcttccctatgaccagacacattttctggatggggaacaatctcaagcaggggatggctggaaagtgttgagtgaaaacgcaagacacgatgagagagaaagaataagtaaaaataaaaaaagagagagaaaaaagagtgaaatagggaaaggctatgtcataagacaaaggtcaaagtgggaaagagtggcagagaacagggaaagcagagagaagaatcttgagatgaaggtcttagcaagtgataatctcctgggatcttctcagtcgctattgatgtctttcccctaggattgtgcaataatttattggtaatgctcaaattgaatttgcaaatgacttcaaaccttagcaggagatactggtagtttatagctttgcaaattgaaattgaaactcaaagtgcccttgataaactgcaaaaaaaaaaaaaaaaagcaaatagaagaaatcccctctagattatgcaatagcacaccaaatgagttttttgaaaaatggaagaggaataagtgaaactagccagctaactaacagcaggcactgattctagaagtaaattggatatggaggtatactcaagtgttggtatttatcctgaggaaatctggccattcaaatgatttcaaagatactcggcctagttctgagcacaattaaagggggtgtggggaacttggaaagagttcagaggaaaaccacaaagatcaaagaggtgaagaaaagggagctcagaggaaagtcgaggagctggaaaaatccaacctgaagaagagaaggtaaaggagataatttaattacggtcctcagctataagacgagcttttcataggtggccacctgttctctgtttccactatggatggatagaaaggcaggggcttaaatatgcaatatgggggatttcatttaggtataaggaatttcctgacatgaaagctggtaaatgatgaaatgggctcctgatcatggacaggaataaggaatattcttcttacaaaataggtaaaattctcacaggtttggaatggtttacagatcttgctacctagagttgggggtgggacagggaagtgggtatactctaacattctagaagaacagattctggtaccttgattttgcttcagacttgtgtatgcacccctcgcctggcccaatgcctcacatttccctggctttacacaaaatgtcctccctggcacaccactttgagatgtaatcatctcctctgtgaaaaagagcactggaaaatatgtttggaagagctggaatttgttgaaggaaaatagtcagctaaacaagacctacatgagtgggggtggggtaaaggcacctcggagtgcatgctgggattagggctaattaagatgttgactgaatctatgctaatcatgtcccaccagactctgctggattagtatgtaaattggtaaactctgttctgaaattgccctaccagctgaggtctaattactgactagacataacaaataataatgggatttgtattttaggatgtttaattatggaaatatatgtctggaagaaataccagctgtattgcacaaaaagagaattcataatgttttactaaagttttatgaaattttacacctttaataagagcaccaggaacaggggtgtgtggggggagtcttttcggagacctagcatttgtgaagggggaccagaatcgcaatgattaattcgctgcttgagtaatttccccaaagctcaaagactgattgtttcagtgccgatacacagcatcttgtgagcttttagttgtatcacccaaagaactggaactcatccgtgaagaataaccaagatgccatggatttaactcaactactccatagcatgcattcaaatggaattaaaagcaatagggcaataatcgttgcaggaaagtaagcccctaaaacaatttttcttcactgaagttactccataatattgaaatcattaaatttataaatcagaaaatggttagtccagtcctgaagcaaaggcatgtattgcatggttttagagaaaagcagcttgagctctagaattcactgaatacgcatcttgggacagaaacttctttgcaaccatttattacatcattctgtgacccaccctttccaaaaagtaacatacaaagagttataaacagagttttggtagagctgtaatagctgcctgtatttgcttgccatagtgctattactcacataattttaaaggcttatgggtgatcattaaatctttattaggttttacattataaaataaattattcatgtcgttctaatacatactggtatctttacagcccttttgcccacatttggataaacaaatcctatttgcatatcatttttattttaatttaaggcaattttgttgtgaaaatataaggcttaaatgcctattatgttccaattatgttccaatttcccacacttttcttggttctatacagtactttacaaataaggtaaagttcacataatttaaaaagacggatgatttccttttacttagaagttttagaatgtttgctcttgctgttatatggcaaggcaatagatattatcaaataaaatttagtgagcaagcttgtgtttgcagtagcttcacgcctctgtacatttgaagttacacatgtatatggaaattaaatttgttgatcactttaacaaatttgtgaattagcaaaaataaagcactaatttttccttgtggtacagaactatagggaagaataatacagtattactttgatgtaaggatatctaacctttgtattggtaagtcattgaataaaataatttttcattaagggcttatgctattagtctttgcagatcttatcagcacattgataactgtatttatttaggtttcaatagtagattttagtttcttgtttcgttagtcttagaaatctaggacacggccgggcgcggtggctcacgcctataatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcaccactgcagtccgcagtccggcctgggcgacagagtgagactccgtctcaaaataaaaaaaaaaaaaaaaaaaaaaaaaagaaatctaggacacgtttgattccctgatggtggatgaataaatctgaacaaactttccctttcaacatcatagtcagttctcaccttcaagcattgccattaagcttgcatgatgtcatcctgtaggcaatgtatcactaaaaacattattttaaatgctattttcccatgccccaaggcacctgtcagtaattatatgttattttctattaaaactaattgtgacccactctcagcattgaacccagggtcagatactctggtataataattctagctttgtcctcttcttgtcatgagtattgggtgaagtcagagtgctgtgagaacatttagaaggttcacagaaagtgtttcaccaacacataggtaagcagtgtgtaagcctgaacagatgtcaccttgaatggaaatctttcagggattgggtagacagctatggtataaatctcatattttttgcaaatctcactttgaagcaaattctacaattccagagagtaatcttttcaacaaatagactttgaaatcccctctctatctttaaggcaagctgtagattatcttgataaatagcaatattgattttagcatagagataattgccccaagatatacctaccattggtcatggggatataaccaaactctcctagtttgctgttccaaatgaagaaatatggagtccttcctcagtggctttgaatatctgtcttagctaagtaggttaaaggacatgggagcaagtcttctgggctgagacagaagacaggagttcaagtctagctgggccattctctgagattctccttcttccactgtaaagagggtctttccgaacaagaattgcaaggaacaaatggaataaaatgtgtccctttcacatagtagataccaaataattgtttgttaaatacatgtctagtagaaaaggttaaatgtgaatctttctgttacacaaattaaaaagcaaacttaaatggcaaggtctcatatcttcctggtgatctggctataaaagaataaaaaccacattcctttcagtaatatctcttggtaagaaatttattacctaatgattaccacagtgctttttaaagcccataagtaaatagtctataattccatattatagcttctacaaagatacagaatattaaagaaaataaaagagaatgtaaaaaaaaataagtttacatctatctttcttggcatgattttcttttaaagacccacctatattgagtgatactgaaatcttcacacgcccagggcagctccacccaacaactagtcaatgataatgataatgaagaacaactacgtcaaggtatcaagatcttacaaaatgtaagcatcattttaggattcctaaggcatttaaaaattttattcaaagggagctctgtcccaacattctttaaacacacacatagcagagtgagagaccttgggattcaaatttcaccctgccattattttatagtgttgttggaaatgggagaatgcaagtgcataacacattaagtcattcaatgaatgtacacaatggctctgcatcccatcatcttgaccttcttattgccttgttctttcccactctcttttagaaaagaactatgctctcacttcatatttatccagagggccttggaaccatttaatttttggtcatctattttttatgattgcaatatggttttctcagtgtggttataaattcttagacagcagggaaataagaactttctccaattttgccctgatgtccaggcttccaggctaatgctccatataaatgttttattttgtcatggatcacaccctactgatagccaggcttctacaggaatgtgcctcagaaaaattcacagttcatcttgatagcagtaattgctaaccctgtggtttgctcccgcccccattaaatgtacaggtagctctcatactaaatatctcacaaaattataattgtttgttaagcaaggcagtagagtgtaagaattaaaaccatggattctggaaccagactacttgacttcaactgccttctctctccttacaaattgcatgatgttgggcaaatcacgtaaggtctccttgcttcagtttcttcatcagaaaactgagatgataatgttactagtgtctaccaaagagggttgatatgaaaattaaatgtagtgtgcttggaagaagctaaagtactcagtgaatatgagttattcctattattattactggtgtcttcacagatgggcttttagcttcttaggagaaaaggtgtttctggccggtgttctatccccaggtcctagtgcagcatacacacatcttctcagagtcccccatcctctctacctccccatcatctacctgagatatccaagtcacaaacctcttcctctcagctgtcctgccaatgcactgtccttagtatttctcaaacttcttgtccttttctctacagattctctcagaagtcatgttctcgacctctctctcctgcattccaacaggcagcctagttgggcctccatctccatagggctctctcagtgagctttctaacatggaaacctgatcattttcatttcacctctccacttgaaatatttccatggctccctactgcctacaagatcatggaataaatacatatcaagttaatataaagaaatttgtgtctgggcatggtggctcacacctataaccctagcactttgggaggctgtggcaggtggaccgcttgagcccaggagttccagaccagcctaggcaacatggtgaaaccccatgtctgcaaaaaatacaaaaattagctgagcgtggtggtgcatgcctatagtcccagctactcaggaggctgaggtgggaggatcacttgaccacaggaagttgaggctgcagtgagccatgtttgcaccactgcactccaatctgggtgacagagcgagatcctgtctcaaaaaaaaaaaaaattgaaagaagatgtggtagtcagaacaatgctccccaccaaagttgtccacgttctaatctcccaaacttttgtatgtgttatgttacatggcaaaagggaccttgcagatgtggctaaggatgtttaaccacatccttcgacatccttcaatatggttagatctaaggatgcaagatgggaagatttccatggggtcacctggtggccccagtgtaattgcacaggtccttatagtggaaagagggaggcagaagagtcagagaaggcaatgtgacgaatgaagcagagtcagaaacatgcagcgccatgagccaaggagtgccagaagcctcttgaagttggaaaagcagggaacagattcttgtctagagccttcagaaggaatgcaggcctgctgataccttgattttagatccattttgtgcttcagacctccaggaatgtaataaaataaatttgtgttgtttaatttttttttgagatgggcaggctggagtgcagtggcatgattatagctcattgcagcctcaaactcctggcctcaaaggatcctccctccttagcctcccaagtagttgggaccacaggcatgtgctaccacacccagttaactttttattttttttgcagaggaggggtttctctatgcttcccaagctggtcttgaactcctaggctcaagtgatcttcctgcctcagcctcccaatgtgctgggattacaagtatgagccactgcgcctggccgtgttgtttaaatttttaataatttgtggtaatttattacagcagccatcggaaactagtacacaaggcaattggatagatagtgctgactaaataattgtgttgcggtaaatgaatgactatactatgagagtaccagactaatgcactgatatatttagaattctttttattaatgatgtgttatgattttctttccctcaaccagtaacttcagatgggggtaagggatgcatttttctacaactccatcctgtcttctgctcacctgctgggggcagaaagtgaggctgtgtcggtatagaaacctagatctttatacaagcagatctctatacaaacaaatatgtcacagcgtacatgcagaccggggctccctactggatagctggtggaaaccagggcaggcatggccagaaaccaaactaaaccaagtctgtaatttctcttaactgagcaaatctaaaatactgtattctgtattttaacctaatatgatgtttctaccttgatgtttcaaaagccatttttacacgtaaatacatatggtgcctgtccaatccatagttacatgtgttggctctctgatcataaaggaagatagggaacaggcagaagctgtcaagggagattctctggaagcattaaggtaagctatagtgagttctcaattgatacgagatctgggaagaaagacatggctggtaagagagcaatatagaagtgtgctaaaaagtgcttttgtggagcagggaacagatttgggtttgctaccttagtagtgtggcatgaatttattcttaaattctctggtccttcattccatcatctttaaaatgggcccaataatacctattttgcagtattgttgagaagagtaaatgataacatgcttgtaaaggggccagggcagtgtctggtatatggtggattcaagacatgttcatttctttcccatgattcttttttcttactgacattattgcaaattatgtgtattattatgatatatcaaaacatttaacaaaagtcatctaacagaaaaaactaatacatcaagaaaaaaatgagaaggaacagtaatttataagctctaaagattaaggatgctggaatgttttgttctgtattttcccaatttgtgcaatggcaaggttaattcacgagaaacctttcttttgaattatttaaatggccagtgatgagaataacacacagtgggtcttgtgcaatgtgagagggttattgattaactcagctcacaggttccaagtagccagtaacatattttaatgtatcaataattcagaagaattaagagtttttcgttgttgctgaaaccacattcgcaactgaaccacgggagctggcaaacaattgttagaacagcacgagttggtctttcccttctagccttggtcgcctctgcaataaactccacaaaacatagctttcatctctaacagcaaacgtgtgccatatgagtgacacccaagcactcaataaatatatgccagattaatgataacctcataaggcagtagtgaaaaatggccaaagtatttcagaagatcaacctggaaagaaaatcaattctaataaacttgacgctctcaggttcaaatataataatgaaggtaaatagtctttataaccagaatgagcatggggtggagaatagtgaataatgttgatcaaaacctgaaaacttcacagttcacagataaattgattaactgttatctcacactcaggactcccaaattgactgccagcattccgtaaacaattcctaaaggcaaagataacatcgtttggttgaattagcattttcagttgagaaaagaataaaaaactgaaattgaaagggaattgactttcattttttggcaaaggatatctcaggcaaataattatttcattttaaaagaaaaagcatatattttttcaggttttcatatcaatgtgcatgcaaagaaactgtatttaaatagtttataacctgtagttgaaacctatattttataacctatagtttaaataacctggttgttattaatgaaataaatggcatgcattttcaatttttgaatattctaataagcacatcatcttaagactgtagaattaagtaaactgaagtaacagttgcagacttgaataatttgtgttgaatcattttacttgatcagtgttttcatgatgggcagattcaactgaaatgataataagtgtattggcatatgttaagtttagaaacaaaacatccatcatcagaactttgcatttagcaatgcttctagttttattttaatgaggaggaaaaaatgcagagagccccctaaattaggcagcactcaaattttctcagggcaaaaacaacaacaaagattaccaccctgtcttggggatgggggagggtgcgcagagtttttaggaatttggttctcagctatgaggaaaggcttctggacttgtccatcacagaaacaacagctgtctgccacttctctcttcttcacacagcccccaactccaaacacgcctctcagaaggacttttgtagcttgcttaagggataatttgcttcagactgaatcaatatatttctaaactcttcaggctcaagtttgccaggatatgataaaaggatatatttatatgtgtgtgtatacatatacattttaaatatataagtaatataaataatgtattctatatatatcttcacacaaatatgaaagtcagctctagaaataacagaatggaattagggagtaagaagcaacatttgcccaagaaggctgtgtgcatgagctgattctttgaaaatgttgaaggaaacgtgtacctattctttctgactctagggcagcttcctcatttcttctttccaattagaactcctctgcatacagacaaagaatataaagttcttcaagttccattttcctcacttgagtgtgaacactctcccctcctttcacagtgtcttgaacttgcgctaggtactacttggatttttaacagtggcttggatctgaacggctcttgttacaaaacaggtgatacatacaatggcaaaaatacattctcacaggaaacagacaattgaaaaatttccagaaggaccgggtttttctctcactctcctgaagttgtaccccccaaactaatcaaattgagatagaaatgctttaaagatccgagtatctgatagataagtgcattcctctatggggtatagtttttgcgtgggcatgcgttttgcttaagtcagttgctcagaagtgatgctaatcaagtttgggaaaagtaaaattgttctgtggctaccagccctttgtaccagaaacagcgccgtcctcatacaccagacagagacgatgcaggacgtccgcagagtcactaaccaacttccctcccttctgacccctgcgcttcagtaaagcaattacagtagcatcccagagcagtagagaataaaatgagccttaccagtttctcctagtgtggacgaaaggaaacaacccctcagctgctctaggccaggcaactgggtctcagacttacttgactgaggggactctgaaagctgaagtcttccttccctctgtttgatttcttcccagcaacctctcccaggatttttctcacaaagcactctcctattctctaatcctctcacaaggaaaaccagcacacacaccaaatgacttctgcagaagcgcctctcctggggagctaggaggggaggggtggaaggggggtgtttgctggcattcattcctgccaggcgaatcctcagggagtcatggatcccagccctctggactcctcatcgactggaatacgataggtcatggcgaggcacggaggtgtgcatttgcttcttcctatatctccaaaccctggtcactatccctcagggatgggagaggggacacctcagcttcaaacttcatctgagtcttatgaccctttatactccctcccataacagagtaattccaaacgagttatgtagaaatcagctagacgcttcccaaatctatctggcacctcattttaagagcccttgacaatttatagcagctgcttgtttttaacttatccaaaagctgaaaacagattgcaaacatcaagaaaaggtggaatatcatatatgaaaaagtgatcgatatgtactatcaaacatctggaaaattactgtctttatgaaaattcatttttttaaaaatcatgtttctaaaataccaaataaaattgctaagttgtaaggcatgaccttctttaagatatggattttaccttatcttcccaggacaggatttgcacttgcatttgaaaataatattcacactttataaattcaaatcctcttctaacttaaggcaaatatcttacatatattccagatatgctataatcaatctggaattcccacttacccctccagtttttaaaaagaagacttacctttttattacgtcatttaaaaccctgaaacgaataaaccacagtggagacaagcagatggcagtcttctacattttgcaatgagggctgtttgccttggagtcattatttctaaggagacgctgctgtgcttgtgcctgtgttcggcagcatgccatttggggctttgaaacaaaatgaatcagcttcacaccaccagctccactacatactaacacttcagaatacccaaactggggcaggctgcctctttcatagtgaccctgcatagaatcagaggtgacggtttgatggatgagtttcccaagagacaatgcaatctgtgacatcacagttctggccgcaccccccaccccaggcccctgtcctgcctctcctctccagaaaaaaaaattgcctctgcttggtgacaatgccatctcaatagcaaaaatgagtctgaggtgcatagcaaatgctataacttagctatctttcttaacctcagttttctgattcccctttgctggagtaatgggagtaggatgagatgaacatactaggcagagaattcagacaaaaccaaacaaaagcacagaactcaatattctaaaaagtttgtaacatgatagcagaataataaccttcaaaaggagcactactgaacactagctcaatgatactaatatctttgttatacgcaatttaagacattttgccataaaattatatgtaagcaactacaaaaatacttaaagtgtctatatcatgtgtttcagccttactagaactcatttagcatcataattttcttgatataaaatagtttcctttccctccttttccttggccattttgctctattctcagttgttctctgtaccagtacctgccaccggtcttaacatttaaaataatacctggataatccatttgaattttggatacaaacttacttgtgagtaaaagctctaatatctttctgactctcaccatcacctctatccttttcacctacattcatctcagatgtccagtacaaagagagtaaaaaatctagaagatatttatgtctgtatctatagctacacctatatatctctatgatcaataaatgtatctacataaacattttaaaaaccttttccatggcaaaataaaacagcatatgtcaagtcaaaagaaataatgaactgggacagagggcccatctccttcatgtttaatgaatgcctaaacttggaaaagagaaaaaaacctaccacccaaaagaaaaacgggcaaaggttatgaaacaaaaggagacatataattagtctttaaatgcatggaaaggtgttctttctcacttgcaataaaatcaatgtaaattaaaactacaccgaagtataatttattgcctgtcagagtggactaaattcaaaggtttggctcatacaccattgatgaggctctggggaaatgggcacttttataggttgctgctgggagtataatataccaccaccaatctggggttgggggagagatttggcaatctaacaaatttatagatgcatggacccttcctcccagcaatcccacttctaggcacctattctacacaatcaccagagaaagcaagaaatgtcatattttcaagcaatacaaggaacccacacaaatgggcagcagtagattgactaatctgtggcatatctatatagtgaagtactatgcaatggcaaaatggaatatcagatctctatgtactaatatagacagatgcccaggcaatgaaaacaaagtgctgaagagggcatggggctgagggaaataagagaggtgcagtgggaggatgaagtctatatatgcataggcttgtatttgcaaaaacaggaactctcgaaggatcaataagaatctaataaagatagtttcttataggggaagggaaggattgtggttaaaagggcagaaacagacgtgagattcctgtaggtttactcatcctcttatgtcaggagtgggcaaactatggtctgagggccaaatcgatcctttgcctgttggtataaataaaggtgtattagtacacagccatgtccgttcatttgagtattgtccatggctgtgtttgtgcaacaatggcactgttgagtagttgcagtattgaactgcttggtccacagagctgaaaatgtttactctctggccctttccacaaaaagtttgttgacccctattgctgtgtaatgagttttagcataagtcaagagacaaactgaagaggatgggatagacttccgtggtttctactttaaaagatcttaagttgagtcctggctgtctctgcctcgttacttagctttcttcgacttgctttcttcacctacaaagtgatgaaggtaatgctgaccccttggttttgttatgaagattaaatgaaacaatgaaaacaaatgtgaaagcaccttgtgaactactatacaaacctcagatattattattactattctttatgagaaggtgacaggtaatacacacacgtaattagtaaagaattagaatagccatggcacttaaaaactttgcagcacttaatgcaaaagcattaccttaaaacttgcatctacattttaaagcaacaattgtatcagctatggtcacatggtaactcagctcttcctattctccacaaccagttaagccattgtatctgctcatctgacaacactgattcagagtgtaaaaccctactcagggcaaggtcttcagactgcagtagaattatttagccttcagagagctcaagaaaaatttctaggcttgaagatacgtatctttacgttcttgaagttaaaattcatcagataaagttatcttaccatgaagaggggtatattagtgaccaagggtatttgggaaccatctggggattatatttgacaaatatggaagcagacttcagtaagactttcaccctcaaaattcgtgtttgcataatcactttaaaaaatttaaatgtttgaatgtattatctttaagttaaaagccagaacttctttatgatagaattaccagttttgtggggttttttgttttttgttttttctatactcagtgatctttccttttcagtcatggaatttgtagtgattgattttgccatagcattttaggtttaactatttttaggtcatacatatttgtgaactactaaactacgttaaattgaactgccaaaagctcacatcaaagttccttaaaatattcatatcctttggcctgcacttctacttctgggaaataatattgaggaaataaggtggctgggcacggtggctcacgcctacaatcctagcactttgagaggctaaggtgagccgattgagctcaggagttcaagatcagcctaggcaacatggtgaaaccccgtcactaccaaaaataaaaataaaaaaatgcactgggtgtggtggcgcggcctgtattcagcaggctgaggtgggaggatggcttgagtccaggaggtggaggttgcagtgagctgagattgtgccactgcacttcagcctaggtgacagagccagaccctgtctcaataataataataataataataataataataataataataataataataatgctacacacactattgtgttcacagacgtatatatatgtgatgtttgtattaaaggcaacaacaacagcaacatcaaaacactttgtgacaataaaaatgtctaaaattaaggaattggttacaaaaattgtggtatggtcattcaaaggcctatcgctagtccttttatctactgctgcataacaaaccacctggacacttagtggcttaaagcaagccatgtgtattttgctcacaagtctgtgatttttggaagggctcagtgggtacagccacctctgccctatttggcaccagctgctgtggctcgaagtctagaggctgcagtcatctggagactcgctcattgcgtggctgacagttgatgctggttgttgcctgagacctcagtgggagctgtcagctggaacatatatatacagtttctccatgtggcttgggctccctcacaacatgctgtctgggttccaagggtgaatgttctaagaggaggctaggcagaagtcatatcaccttttacaatctctcttggaaatcacatggtgttacttctgctggactgaggcagtcataaaacttcacccatgttcaaggtaaggggccatatattctacctcttggtggggcatggtgaggttcagaaagtatgcgggggcgaatggaaaggttgctgttgtcattttggagagtacaatcacttgtaattatacagtcattaaaatgatatagcacatccaaatttattcacacgaaaggacattcaaatgatagtgaatgctgagttggcagtgtagctatggtgtcattcagtagaaataacactggcacttaatagacactcaataaacatttgttgaataaacctttgtgtaaaaacaaataatatcttttgtttgtgcctatagtgaaaacattctgtgagaagctacatcaaaatgttaatatgagttgggcacggtggctcatgcctgtaatcctagcactttgggaggtggaaatgggaggatcgcttgagcccaggagttcaaaaccagcctaagcaacatagtgagaccccatctcaataaaaaaaaatgttaatattggttatatttctgtgatgggattgcaatttaacttttctaagattgtgagcttataatattcttataataaatgtgcatagaaaattaaactgtatttcaaaatgaacctcagaggacaataacctgagttgattgtcagaaagtttgacctaatttcttttcttttcctttctttttatcttttttttttctttgtagataattgaaacctaattattatgctccctggcaaagcactttttcttttttctgcttgtgggaagaatttattgttcagctatctgtaagcatttaattgctgcaaagtatttaacggatgtaaaaataaaaattttatttttcatttgtgtaacacaagagcaccagcaacataaaatgcattttaaaaaagatagctcgttaaaataaatataatttgactccaaattagtcatacctcagtgagaataataaataaactcacatttaaatcagtgaattagcaggatatagttcaatggagacaaggatatcagaaaagaaaaagcatggtgttcatgtaatgttctatgctgtactctcactaccttttccctgatcattaatattttaaaaaatatattaaaatacaacttatttttggaagtcaaattgctaacttctcgtataacaatactttgaaagtgcttttaaaccagcttctagaagttatatatggacaaatttgaatgtcagattacctctctggtaagagagcaatccacaggcaaagggtcaaatctggggcattgggtggaagttgattaaacacacagtcctgaaataatgagagtcatttgtgtgaaactagaaggagagtatagctttaactgaacttatagaccagtttaacagtaatcagcttttagtcaactttggcatactgtgctcaattgtagtcattttctcttccttgatctcaactgaaatctctcatactttacgtgagagctgttatttcaacccttgaaaggtcactcttctgaaagaatgcttggatgaactcagccctgattctctagaaataaaaagtttcacttcaaatgtttctatcaactcttaatgacagaatcattaacatctggcctggcatggtggctcacacctgtaatcccagcactttgggaggctaaagcaggaggatcacttgaggccaggaatttgataccagcctggcaatatagtgagccctgtctctacaaaaaagtttaaaaattagctgagtgtggcatgcatctgtagttgcagctactcgggagactgaggtgggaggatcgcttgagctcaggaggtcaaggctgcagtgaggtatgatcatgctgctgcactctagcccgggcagcacagtgagaacttgattaaaaagaaaaaagaaaaagaaaaagaatgaatctggaagctactgtctttggtcctcctctttggatttggaccttctctcattattcaattaaatattacacgcacagagacataaacacacaagcaagtactctgtgatttaacatgtgcttgtaggagttgaagactaagttccagccattctggaagggcaggagatgatctgcacagaaggaattgcacgtcatcttttttttttttttttttttttttttttttgaggcaggctctcaggctggagtacagtggcacgacgttggctcactgcaacctctgcctccctggtttgagcaattctcctgcctcagcctcatgagtagctgggactacaggcatgtgcacgacatctggctactttttctatttttagtagagacggggtttcaccatgttggacaggctggtctcaaactcctgacctcaagtgatccacttgcctcggcctcccaaaatgctgggattacaggcatgagccaccgtgcctggcagcacttcatcctttaaaaaagattttgtttcgttttggctttttgtttgtttgtttgtaagttaactgctttaaggaataaatgctcaatgtagaaaatgtggatattaaaagatctatctaagaataaaaatcacccataactaaaaaatgaagtgacagtcactattaacagtttgatacacatacaggcagatagagataaaattcaactagttgggtgtatagtggaggtgtatatatttttaaattgtgccgcttgcttgcttgcttgcttgctttctctctttctttctttctctcttttcttttctttctttctttctttctctttcttttctttttttttttttgaaatggagtctctctctgtcacccaggctggagtgcagtggcgtgatctccgctcactgcaacctccacctcccaagtttaagtgattctcctgcctcagcctcctgagcagctgggactacaggcgtgtgccaccatgccggctatttttttttttgtattttttttagtagagatggggtttcaccatgtttaccaggatggtctcgatctcttgacctcgtgatctgcccacctcagcctcccaaagtgctgggattacaggcgtgagccaccgcgcccggccaattgtgtctttttctaagtgtcattactttggaatatgtaacaactttattaggtaaaatgtgcatattataaaatttacccatttaaaatgacttttagtaaatttgacaagttatgtagccatcattaaaattcaggtttttaacacccagtaagacctcttatgcctatttacggttaattcctgttcccaccccaagccccaggcaactccttcctgtctctatagatctgtttttctggacatttcatataagtggaatcatagtcttttgtgtttgccttcttttactaaataaagtgtttttgaacttcatgttgtaacatgtatcattactcctttagtgtttattgctacatagtattctattatatacatatgccacaacttctatctttttaaaactaaatatcatgtcatgaatattttatgtcattaaaaatttcatgtaaattcccatttcaatggccataatagttcattatactataaagtattaattttttctattgctgtgtatttactattgttgggactcagaaaacaataccccaaaatgaaggcctcagaagcaaaagtttctctctgaccttctccttcccttctgtctctcagtcacattctcccttgaggctagccatagaaactagaatccttcttccccaaggtggatcatagaaaccaaaactgcttttccccaaagccagccataaaatctaaaaatatcactctaactttccctccaccttatctgtgtaaaaactggccataacgaaattccctgacataccttgtttgactgtaggtcataacacccccattccagagagggtcttgccttacacccagaaggaaggaacgctgctcagagaggccaagaagaatctagacagacaggccttgctgggtttccacactcagtccattagctttagatcaggccctttttgtccaaccctgtttctacacgctgtccgtgctttgttgaacctaagcataaaaatggataatttcccctgtatctttgggccttccttctgaaggctcctatttgtatacattaaatacatttgtgtgccttttctccaattaatctgtcttttgtgagttgattttttcagtgaaacttcaggggacccctcggcccctacaccccacatactcatacacacacacacacacacacacacacacacacacacacacactcacccctacctgtgtagtacaagatggaaagaaatagggtgggatgcagagacacaaatccaaaattaggtttctatccagtggaccagtggatgagaaggtttgtgtttaacaaggatgtgtctgtgcctcttgcagtttcatgagaatgtgagccatctgggaatctggttaatgtgaagactctgatcctgtgggtctggggcattgggatgtgagtcactatcatcaccatggctcagagtctgtgatcttgagagctgatggtggtgctgaccatccttctggggaagggggtttggtgtcaccatcaacccttaaggctcgggtgtgctggctgggcagggggctgtgtctaaggggttcggggtcaatggattaggttccaccttcttcatctcttatatgcccaagagactaggcttcatcatcaccaatatcttctgcatagatctagtgttggtcaacatggatgactcacttccaggtttactgagaccagcagcttcccacatacattgactacctttcttatgcccacaacatggcccccacagatgtaaaactatgatcaaataaaattgtatgccttttctcctattaatctgcctcttgtctgaaattttcagcaaacctccacagggcaagggtaaagctttcccttagtcccaacactattataaaaaatactttgttgttgcagattgaggtctccagaaacacatgctgaggtggaatttggggtgaagatacttactagagatccacatcagtaaagagaagggggaagaagcaagattgggcagacaaagcagccaaactgcaatccaggccctacaaatccttggacaacctggctgagagctctggaacaagcgttgcagatcagaattgtctcatgtgggatatagatggttgtgtctttatgtccctgtctttctcaggcatcagatgcaggctgctctgggaagcaggggacattgggtgaagtgactctctataattgtgcagcctctgagctgtgaccttatgggtggaggtgtctgtggaccccattccaggagtgagatagcaagtccttccttggaaggggatcttggcagtgcatctttgtgtttgcccaacccttggaattgcccgtctaatatccactgttacctttattttgactaacagaacacccaaatttcatttgcagctccggtgttttacatattctctgccctgacctccttcagaggtaggaaggaccaagtaacatagttgggccaaatagatagagccataaatttctagataattttatctagacacgataattttatcaataaaagagacaaaacctcccaaggatgagtcttttgtctcttaaatttctccctttttcctgcctggaacttgagactatgaagacaaaagtcagcctaaagaaggcagggcaagaagctacctgggtgattttctcaaacaactgtatcggcttgggactgccaaatgcctggcttcttgcacgagaaaaatacccccatcaccttcttttgttcaattcagtatggtagggtttctgttacaggcagccaaatgtagtcctgtctggaacagtatgttagatatgttagcatatacagtagatgtgcatttgtgattatttctttcagattgagtccaagtgagaatggtgagtcaaaatatttttaaagttctttgtgcctattgcgaaagctttacaggagggttttacatattttattttaatcagtaggacatgagattttcttactgaattatgccaacattaaacattttttaaaaagacagggtcttgttctgtcacccagtctggagtgcagtgacgtgatcatggcttgctgcagccttgacctcccaggctcaagcaatcctctcacctcagctttctgagtagctgagaccacaggtgcttgccactatgcctacctacttttttttctattttttgtagagatgggggtctccttatgttgcccatgctggtcttgaactcctggactcaagtgatcctcctcccgtcgcttccccagagtgctaggattacaggcatgagccactgctcccagccaatgccaatatatttttttctttttgagatgagatcttgctatattgcctagactggtctcaaacttttggccttaagtgatcttcctacctcagcctcctacgtagctgggattacaaagtgtgaggcacgtgctggctaaacatttttttaaaatctcttttattaggagaaagaggatagaatcacattgcattcttaaatgtatacactttgataatttatgaggttataaaatatttttatttccttttctctaaattatctattcaaaagtattttttcccatttttgtaaccagcattttggtacttttcttattagtttgagctctttatataaggatattacttctatcctctttctgacaaatattttcctcctttttgttgcttgccttttaatttcattcttactactttttatctttcagaaggcagaaaattatgttcacaaatatagcatcaactgttttgttattttgtctacggtactcacacctagaccatccttccatatttagtgaacaaagaaatgtacaaatcaattttgtctttttaaaataattttgctttttttcacttgattattgaattcatctttaattagtttgtggcatgaggtgagattcaattttttttctcaaacagccaattttcttcatacccatatgttgagtaatctgatggtatatgttaaattcatatactgtattataggagagacaatgccatatgttaagcaaatccctgtctctttcccaccttggcacatatgaattgagaaaagaaaaagttcagaacagtctgagctatgtgaggtctgcaaaatttatcaggccatacactgttctttgtgtcacaaaaatacctatcctctggcttttttctgaaaaagcttgttaaccgctggcctagtctgtatttatttctctatcttatttggtggatggatgttgagtatccagcagaggattttgaggatctagcaggatacagagctactagatggagggaatgtgtgccccatttgacagaatgggacaaagttccctaatgacttcactgaattctgattagattatgttacaccactgaggtgttcagactttacatgtgttaattatctgtatctgtattagttcgttctcacactgctataaagaacaacctgagactgggtaatttacaaagaaaagaggtttaattgactcacagttctgcatggctggagaggcctcaggaaacttaacgatcatggtgtaaggcaaaggggaagcaagcacctttatcacatgttggagcaggagaaagagagagggtgaagggggaagtgccacactttaaaatcatcagatctcataaaaactcacttactatcacaagaacagcacaggggaaatccgccccatgatccacctcacctcccatcagttccctcccctgacatgtggggattacaatttgacatgagatttgggtggggacacaaagccaaaccatataaatatctatatctatgtatatttatacctacatttatatctatacctacaccaaaacttatgtccacacctatatatccatatctatacctaaatctctatctgcctgtctagtctttttttctgggctttgtattctagtcttgtgatatcaccgtgtttcaaatgttgtagattttttttttttttacctcttcctctccccttccaaatgtagatttatagtgcctcttcatgtggtagggccaatttccttctccttacacattttttccccttttattggctgtgctttcatgtcaattcttttggcctaactttaggatcattttgtcaatatctggaaagaatttcattgaaattgcttcaaaagaatttaattagagaattgggctaaatcctaaaagacaagtactctttatagacagagaaaataacatgtgtaaaaacttggagtgtccagaaaacaggaaatttggagtgcttgttaactcttggattcatgtctaaggagtgacaggaaatgaggggcagggtgggtgggaggcaagttatgacaataccaacaacaatgacaaccctcagttagactttcagctaactgtaatcaagatgctgagagttgttcaagcattacctcagttaatccttcccaaatatctatgaggtcaacacgatttgcaactccatttgacaaaggagacttgggctttgaggtgttaagtacctggctagagatctcttggctagcaagtagtagagtcaatattacaattcaattcagcctgacttcaaaaagcagtatttccaaaccgggctaaaatgattccaatacatcatgtatgcaaaaagaaaccattgaaagattataagaagagaatcgtaagaagagatttgcactttgtgacaataaggctgttagcgttatccttctaaaatatgaattcaagaaactaggtataatggtggctactttagcaacatcatattcctactgcttgtataattgaaatcttaatgaccagtgctcaccaccgacttcagtcctacaatatgtggttaccaagcattcagtcaggcttccccttcaaaccacttactacatttgaggtgaagtctattctttgggttcaggtcctgtgtgatcttgggtgaatcactgtacctcttggtgcctcagtttcctcacctgcatactcagagggagggactagagatctgtaaggcagttttcccaagtactgctccatgtcaaaggattccctggtctaaatcgaaatgggcaaaataagaaccatatacagagttgttcttggaaggcaatttattcaatggaaaggactctcttttattctgagattgtaccagttacacttttgtgttgttaggcattctttttagtgctttgaaatgatggtgatagtggatggcatctctatttgtgatggcttttactggaatccctaccactgtctccttgtgatttaactcacaggcccaggatcctcaggagtgtgggaactacattctggcagtcttctaatacaatattttagctcagtgctgtctaatagaaaaatgtgagccatatacagcatttcaaattttctagtggccacattataaaagtaggaagaaacatgaaattaattttaatagtgcattttatttaactcaatatatatccataatacaataattccaacatatagtcaatataaaaattattcatgggccaggtgcagtggctcacacctgtaatcccagcactttgggaggccaaggcgggcagatcacctgaggtcaggagttcgagacctgttgtgggaagtcagggaccctgaatggagggaccagctagagctgaggcagaagaacataaattgtgaagatttcatggacacttatcagttcccaaaattaatacttttataatttcttatgcctgtcattactgcaatctctgaacataaattgtgaagatttcatggacatttatcccttccccaatcaatagtcttataatttcttaagcctgtctttactttaatctcttaatcctgttatcttcataagctgagaatgtacgtcacctcaagaccattattgtacaaattgattgtaaaatatgtgtgtttaaacaatatgaaatcagtgcaccctgaaaaagaacagaataacagcgattttcagggaacaaggaaagataaccataaggtctggctgcctgcagggtcaggcagaatagagcatatttttcttctcacagaaagcctatagatggatgtgtgaggaggagaaatatcgctgaattcttttcccagcaaggaatgttaataattgataccctggggcaggaatgcattccttgggggaggtctatgaatggccgctctgggagtgtctgtctcatgctgttgagataaggactgaaatacaccctggtctcctgcagtaccctcaggcttgctaggattgggaaattccatcttggtgaattctagtcagactggttgtctgccctcgaaccctgtttcctgttaagatgtttatcaagacaatgtgtgcacagcgggacatggaccctcatcagtaattctaattttgcccttgcattgtgatcttttattgccctttgaagcatgtgatctttgtgacttacttcctgttcgtacaccccctcccctttcaaaatccctaataaaaacttgctggttttgcggctcgaggttgccatcacggtcctactgatgtgagatggcacccctggaggcccagctgtaaaattcttctctttgtactctttctctttatttctcagaccagccaacacttagggaaaatagaaaagaatatacgttgaaatactgggggctggttcccccgatagagaccagcctggccaacatggtgaaaccccatctctactaaaaatacaacaaaaattagccaggtgtggtggcgggtgcctataatcccagctacttgggagactgaggcatgagaattgcttgaacccgggaggcagaggctgcagagagctgagaccatgccattgaactccagcccgggcaacaagaatgaaactccatctcaaaaaaaaaaattattcatgaggtactttacattctttttttgtagtaagtctttgaaatctggtgtgtatttcacacttacagcatatatcacattgaattcactatatttcacataccccatagttatgtgtagctagtggctaccatattgaacaggtcaagtctagaattataattcagaaaatagtgtagcttcaggcatcttatggtggtttttacatggctcaccttcaacatgttggtttttcccagagcttcatatttctttctccttcagtctttagttgaatgagacaaaaggatagttcgaaggtaactaatcaacacttcttccccaatgatgagtagaaactgaattcactattccttcccaccaactcttcctctagcctgacttccttatctctaacgatcctgtttcaagtagtttacatattccattattttcctgcccttaaatttctatgatgccccctctgatcgatttgtttataaaaaataaattttgtaagaaagatgcagtaagtttgactaaacacaatatatactctaactaatttaaggtgttttaactttttttttttttttttttgagatgagggctggctctgttgcccaggctagagtgcagtggtatgatcatggctcactgcagcctcgacctcttgggctcaagtgatcctcctaccccagccttccaagtagctgggaccacaggtgtgcaccactgcacttggttaatttttttttttttggagacagggtctcactgtgttgcccaggcttgtcttgaactcgtgggctcaagtaattctcttgcctcagcttcccgaagtgctgggattataagcgtgagccactgcacctggcccttaactttcacattattattttttgacatccagaggaatcctttaaaatagggatgatggatattaacagttctagctttggagaaagaaatatatattcagagaggctaaatgactatcaaatatacatagcttgagtacatctatttttaggattagacatgttgatatttaaaatctgaatgaatattaccatgtatgtatgtgtgtgtgcttatatttggttgattccttccacaagtatttatcaagtatctattatgtgctagtctactgttctagatgatgacttcacactaataaacagaaagtcagagctattcctgccttcccagaagttatagtttatttggaaaaacagacactaaacttgcgaggacagtgaagtgaatgagacctacggaatgggaggtaaaagtagcattagggaatgaagtagcaaaacctaacctcttctatggttccttggggactcactcagaacccaagagttggcataaagattattttaacctgaagtcatttgagagtcaacagatgcagaaagaagtctttgtggagcttcctttttctgactgaaagcagaaacttctgagtaatgaggactgccacagattctttctttggggcagcctctactcccaggagagagacaaagagtaaacctaccataaattccctctctgggggagtttcatggccacgaagaagatggaaacaccaatctcacttatataaacaaacattatcacaaactttcttctctcctgttggttttcctaaaaagccgtttgtttcttttaaataagcctatttgttctttccatagaagccttttctccactctttatttcccctaacaagctaggtatataagccccaaattctaaccacccctctgagttatacatcactgagcactcctgcatgcacaatgtgtgtgtaaataaattctgtctcttctgttggtaatctgttttgtcagtttaaatttgcaagtccccaggcaccaaacctaagagtgtaggggaaaagtttttcctctccaaccatttttttccagaggaatcaacttttgcgaagggtaagtcggaattagcctagttgggtgggagggatggtggagaaagtgttccaggaaaacacttgtacaaagaccaagaaataagagagacaaacacttggggcaaaggacttgagagacgttcactagtgctggattgcgaattttacaaagcatggtgaaaaaatagatggagttgaaaaatgcctttgcaaaaattttaacagtgtgaaaattatgacactaagagaaatctgacataattgactccatcttgcccttaaactgcccttggtcctccaaatggcccttggtcattcctgggcttgggccaagctacctttgggagaaacttagtttatagtttaaatgataatagcccctccccaaaatgaaactgcccttgtaaaactaatgaaaggccaccaggttaggacgatgagaggggcctgaagtctgctaagatatagagtaggtaaatgattaccagccattatttggggggccacaagatttgcaacttccccaattactcctgtaattaacattactattatagaacctaagattggccccttttcctttttgagacaggttctcattctcttgcccaggcggcagtgcagtggtgcagtcatggttcactgcagctgccacctcctgggctcaagcaatccttctacctcagcctcccgagtagctgggactataggcacacaccaccatgcccagtgaatttttctgcatttcttgtagagatgggttttcaccatgttgcccaggctggtctcaaattcctgggctcaagcgacccacctgccttggcctcccaaagtgctgagattataggtgtgagccaccatgcccagcctaagattggccttttgaggtatcttttcaggcttttgcatttctgactattgaatgcccatcttccacatccttatgattacattcacagcccatcagcagcacctataccctagccccctgcccaccaaagtatttttgaaaaaccctagcctctaaattttcagggagtttgatttgagtaataactccatttcccacatggtgtggctggccttgtcaattaaactctttctttactgcaatgccatagtctcagcggactgatttttgtctgcgcagcaggcaggaagaacccatcaggcaattacagagttggaggaataggcaggggctagactgtgctgtctaatacagtagccaccagctccatgtagctattgatcatttgaaatgcagtgagtctgaaatgagaagggatgtaaatataaaaatacacagtatgaaaaaaagcaaaatatctccttagtaaatttttaaatattgattatgttatagtaggtggttagtcagacagaagcagggcaggagagccccccgccacacacacacaatgaggaatgtcaggcaaccatcaggtgatggtcaggtggttgttaactgtctctctaaaataataattggttatacccagtgccagggaaagacagcctcccaatacatagaaaacacctaaaactggtcatcagcagcttcctgataagatctcaggagttgggcgagtgggctcaagcatgcacactaagaggaaaaatggcagaatttaactggtatatgaccttcgtctaggatcactcgactagaaaagggaaaaatgcctcaagtgagcatgtgcatcacttcagtaaacacactatgcatgcagcaactcccaaatgctagcaggcctctgtgcatgtggacagccctccccaagggaagaagcaggggagaagagatgcaacactgaagcatgccaatatataaaaccccaggtcaaaggtcaaacaatgtacttgaatctctcaagtcacctgctttgccctcttccaagtgtactttacttcctttcattcctgctctaaaacatcttgataaactttcactcctgctctacaactcgcctcagtctctcacactgcagttatgcccccttggtctaagtctttcttctgaggaagcaagaattgaggttgctgcagacccatacggattcactgctgctgacaattacatgttgaaatgataataacttgaatatattgggttaaataaaatatattatgacaattaattttaattgttttaatgttgctacctgaaaaattttaatacatatgtggctggcattatatttctattggacagcactgctctagaccaggaagcacctggaaagctaagttaggacttgtttgtagaacaatgatgtatccaaaaataacattaactataagtggtcacgatcaacaattttcacccaactatatgctggctaatgatcaccttgtttggaacaaacaggaggctgaccttgtccataatctctgtttttaaaaagtcattattagtgcaattccaatctcagtaagaaatctttactttcttatacattggctaccctcctgcctccacttcaataggcatagggtgtaggaacacctctaggactccaataccatttctcccacttatgaaaaagttgagagattggagattcctttaattcagaaatctaccaggtggttttgctttttagttacaaaaatctgctactccctccaagaagtagaaacaaaggattcgcagggctactctcagtgggtgaaaatgctgactattctacaaaaggacaccactgccagctcttaatagctctttaatgatccgtccaagaatcaacattgaaaggactggatctcagaatgcctcagaggatgttccccaaattcatattagtccaaacaaaaccaaaagaaatattgagaaaaaccaaaagaagcttggaacagggcaattgagggaagagaattgtctccgaattagcaggaatcttcagaataaggagagaagatgatttattcatgattgcctgtgtgcattcatcactgatgacttttttccatgaaaaatctgctctaatgaggctaattaaaaaaaagctcaaatatctttactcatgattcagtgtggttgcttaaaagcacataagatttttacgaattgattgaaggttttggtctctttctaaatatctggcatggcgtctgcgggtgtcctgccagtggtggtttgtttttggagccgtggttgggcagcagggggtggctgtgtgctgacatgtggtgtatggtgattgaaaacagggtttctccatgacagcaccacagacattttggactgtcctgtgcattatagaacgtttagcagcatccctagcctctacccaccagatgccagcagcatcccccacatctcagttgtgacaatcaaaaatgtctctagaatttgactaatgtcccctgggggaaagaatcacccccactctcactctgttgagaaccactgatgtaaccccttgaaatatagtatgtagagaggcatagacttcaaagtattgatgtgggcttccccaattatttcttattcctcagtgctatgatgcatatctttaattgcgtgtttctaaaatatttctagtaagttgaacaatgatggagagagcatgttttccattgagccatgacctcatcaggcaggctgagatttgagccatggtctggagggaccatttactctggtcacatgttgacattctgatgtggtgacacctgccccccatccctgcaaccatccagaaaaaacagagaaatgaaatagcctcataacaccaacttgtgttcgcccttgaattaaatgtaaatgatgatctgccttagtttttaaaaaacggatctcatttaaatgcacagcttatgtcttatatacatagttatgtcttatgcacagctaatatcttatgcacagcttatgtcttatgcacatggttctgggcagccagttcacatttcatagtaaggtaggctgaatctatatgggcatgctattctgaatgttgtactaaaggtgattcaggaagggtaatggagcaccattttatagccagggaatcaatatcctcagtgctcccacttctcacttgtacaatcatttccccattgaaagatatcagaatatgccaccacaaaatatgctactttgtcataaggattattttgagctgaaggcaattgagaaacagcagatgcaaaaaaaaagaagaaaaagaaaaaaaaaaaaaaaacaccgcagtttcctccttcctccttccccgtaaaggcagggaatgcagggaatacattttcctttgtgaaagtgtcccctctccttttttcttgtaccagaaagaggagacaacttctattactggagatcacaagaatttaaatctgcataaacaaataaaccttactaaaataacccttgtcttccattagtttcctccatgtatctaccttcctacaatgtactgcccctagcagccccaaaccctttcctttcacttgttattttttcatacatttatttccctttgctaaaatggtatataaggccctggctctgactacttctttggggttttcacttcatttctgtgagatccccaatgcttatatgaaataaactccattttccttttaatcttttttttcaagtttagtttgcaaggccctggtcactgaatctaagaggttagaggaaaaatgatttttttccttctcaacatgatgttggccctgggaaggggccaccaaggtggatgcacaacagactaaattgacaaaacgtgctgcagttgtgcaaataaatgggactgatatcttctatctagggaaaactttataaacacttttattccaccatctggcctcagcacttttaaccatcattaaataactaaatctctgggcagctctccccttattttctataaggagttgtccttttgagaaaccgttccattgtaaactgaaggctgcagtttggagctttgaccctgtaaaatttgtttggaggctcacattggactcatcacttgttttctctggccctgtattgatagaaggggctgatctttccctggagcagttacttgagcttgcccctttttcctgagtaattatgttgtacttcttgctggtgtcacccttagtctctgtgaggcaaaataaatttctggacatcacagagtctacaaattaagtcagataatcacaaatacagtcttcaaatatgttaaagcactgtctagatctttttacggtgtgcagtttttagatagacacttgtatgtagattaggaaaagtggctagctcaatacttttttttttttttgagatggagcttcactcttgttgcccaggttggagtgcaatggggcgatctcggctcactgcaacctccgcctcctgggttcaagtgattttcctgcctcagccacccgagtagctgggattacagacatgtgccaccacgcccggctaattttgtatttttagtagagatggggtttctccatgttggtcaggctggtctcgaactcccgacctcaggtaatctgcctgccttggcctcccaaagtactgagattacaggcgtgagccaccatgcctggctagctcaatagttttaataaagttttactgtaatatagttgtaaggtaaagttatcctgcaacatagcaaaaacctgttataattttccttatatttaatgtattttatacttatgggctgtaaaaaatatgagtatagaagatagggtagccaggcatgatgcctcatgcctgtaatttcaacattttgggaggcagaggtgggagaatcacttgagcccaggagttcaagaccagcttaggcaacatggtgagtccccatctctacaaagaatacaaaaattagccggccatggtggcatgcacctctagtcccagctactcaggaggctgaggtgggaggatcacctgagctctgggaggttgaggctacagtgagctatcatggcaccattgcactccagcctgggcaacacagtgagaccctgtctcaaaaaaagaaaaaagaagacgatagaataaaaagaactttccaaaaagttctttacatttaggagagcatgacttcaaatgatagattaaggggcacaatcttatgtaattctggggcagagaaaagaggaagcagctttaagacatcttaggaaaaaaactaaatttgccttcaataaatacaattaaaggagaatcaaatttttgactgtttggaaaaaagaccaggtctctcctactctatgatgatgtggagtctacatgtgcaataataatgttcttttgtgacatcgtgggaaaaatgaatttggagactttagcattactttaaaaaatgccatctacaaacaatgttgaattatgaagacaaaaagtcatttattttggtaactaaagagcagcttacaagcctggacacaaaccattgagaatgtagtgatgaaacacttacttacttttttgttttttttaaatgtaaaatccagaacaggcaaaccatcaagctggaaaaagaaattaatataacctcacaggcaagaggaaaagtaaatactcactctaaagcagccgctgttgatgcaagcaaaggttagagcaacatggctgttttctaacaaagtgtgaatcccattagtgctgaagtgttatcccttccttagttcttacatcgcaaccagaacagatttaggattttacttccatctgcatctcaaggctggtaaataggacccatgaagatgtgcaaaagtggtgaagccattcaaaaaactttgacgtatacacaatagacagtggccaaagtctgctcaaacacccctttagcatgcttagaaggacaaaatagggagttggcctcccccagtttcccagcttcccctgcgacccccattgtctcttcccaaatacacaatgatgccattccgtggctggtaaatgagaaacggagcacttggaaaagtttctttgggaagctcagaatttaaactttgttctatttaaagaagaaggtggaattagaggagatgcggcagcagttaaaagagtaaaacatctggaagttatcaacacttgcttatttgtgtgcccaataccaaggtgatatactaattttaatattgtagtcaattggacattggttgtttattatagcagctcatatgcaaatacttgtattcatttttccctggatcaaaacctgtcaagtatgtctcctaagccagattgagtcattgagcagaaccaaataaaatcacaaaataaagttacctattctcataaagaaaactccagtgtaagaaaagctcataccttggcaaagattttcaacgtggttgcaatcaagtcattttccaattgcataagtaaataacattgaccacaagaaatattctgccagaagtacatagttgctatgatttttaaaaatgaaaggtgtaaagctaagtgttcaaattcaaaattattgcaatcatgtttctgcactgaatgcatgcagtgaacatataattatgccactctgcatttaatgcaaagaatatttctatcttaaggaaaaagtgtctaattcccaactgcacagaactgtaccaacttgccaagaataaggaaatacaaaatccactggaaataacatttggttgttcacattagcattgaagacgactgtggtttcgaaatttccctttttttaattacagtgagtaaactatttggccaactctctttgggcagctcaattttcatcctagctcactggcctgaaaatgaagctgtcaagagtcctaggttgaatttgtttttgtgagaagaacgtttagtatagtatgtcttcaaaaatcgtggagaatctgttcagaaagatgtatcttctttaaactgagtctgatgaatagttttattatacaaactgaagaagatctgtgtgaaaagttccttaaaaaatttaaatcacatatacaccaagacatattttagttatcttatttgtctttaattacacatccttatcagaatctatgagcaagttgaataaatatcactgtgtttttcgaaggcaaactcacatttgcaccaatacaaattatttttccatgttcatttaaccaccaggaaagttagttgatagttatcaaaaactctattggacagtttactcttttctacaaataattaacattatggactaaatgtttgtgtcttccccaaattcgtatgttgaagccttaacccccagtggggttgtattggagttggggcttttatgaagtaattaatgttaaatgaggtcataagggtgaggctctgatccagcaggattagtttccttataagaagagacaccagagagcttgttctctctccacgaggacacactgtggaaaggtaatgtgaggctgcagcgagccaggaagtgagttctcacctaaaatggaatctgtggacaccttgatcttggactttccagcctccagaactgtgaaaaaaatgtctgctgtttaagccatccagtctgtagtattttgttatggcagtccaagatgactaatacaatgaacaacataatttattactagagatatattttagttagtaacttgtcactacattacggtttcaggagcaaacaaaaagtgtgccaagattcaagaagaaaaagtaaccaaaaatcatgccatcagcacctttaatctttaagtattattactatttcttactaaaatggtacagtttgcaaaatccacacaagtaaatgtggtatttagctaccaacttatacatttcacgaagtaactgcaaaatataagcagatagttgttaagtttattatatcaggctgggtgcagtggcttatgcctgtaatcccagcacttagggaggctgaggcgggaggaccacctgaggccaggagttcgagaccagcctggccaacatagtgaaaccccatcactactaaaaatacaaaaaattagccgggtgcggtggtgcgcacccatagtcccagctactcgggaggctgaggcaggagaattgcttgaacccgggaggtggaggttgcagtgagctgagatcatgtcactggactccagcccgggcgacagagtgagagtctgtttaaaaaaaagtttattatatctaaagacagatttttagcccttgaaggcaatgtttaatacattctttttgtacacaaaaataaaggcaatagagaattcataaagtaagatgtgattgaagaattttagaggtgctttgaatccttttttccaatataattttctcattttaaaaacaagaaagaccaaatagtggatgaaaaagttcaaaatagttcctttttcttcgaaaatcaacacatactgactaatgccaattccgtttcatctccagtgtctgatgaatgaaatgaggtttatcctaatataaatatctaaaacaaatctattgctaaaacatctcttggagagttgttataacgtaacttttgttgatagactagttattgcctattgtaccaaaaccatatgatgttagttttataggaaaagaacatgtaagtgaatgttttaaaaccaatgaataatgaagtacttagcccaatccctctccctacccagtgccttgtccaacaggcaaaataacctgtcagtcaccttactttttaaagtggttataaagtcttcctatttatactttactgcttgtacttaattgtgacattttaaaggtacatttagctttaagcttcacttattatgtcattagcaggtcaacgttttcttatgactttttttcctgaagaaaaacacagtttaaagagagctcagggactactgcgttgctactgtgtggtgattgttagtaacacatcaaagggaatagccatattcaaagtggcctcccactcctcttgtcaccagtagctctgcctcccagcctttatgggcccccagactcttctgaatgttgttgtggtttgcttttttgaagccagcaaaactccatcgagctggtatatcatgtgaaataacagcaaaagttacaacagaatccaaatgtcattgcatcaacaaatattatggtattattgtaaaaggagatgagtcaagaaatatatattatatatataaatatatgtatgtgtatatatatgcatgtgtgtgtgtgtatatatatatatatatatatatacacacacacacacacacacacacacagagagagagagagagagagatggagtctcgctctgtcacccaggctggagtgcagtggcgcgatctaggctcactccaacctctgcctcctgggtttaagcatttctctgcctcagcctctcaagtagctgggatcacaggcacgtgccaccacgcccggctaatttttgtatttttagtagagacaaggtttcaccatattggccaggctggtcttgaactcctgacctcgtgatccacctgccttggcctcccaaagtgctgggattacaggcatgagccaccacacccagccgagacaacaaatatgaaacccaaagaatgacacataaagaaaaaagaagataataatcacctagccttttttcttttatgattttattttattctgattctcaaaacattgttacatttaatttgctaaaccttgttaaacagtaggtggctattggataaactttaataggaaatttgagactttattaaatccctttgttactatgaagtcaatgtaagttttatggtattctgggattaactttttgcatcttaaaaatagagacaactatgaaaactgtatctaggtgagtgaacttgatttctcccagtatgcctactgcagtttctacctctaaaaggctacatcatcttgagcaggttgcttgatatctctaaaacccagtttcacattttgtttcaaaagttctactccgtaaatattgttgagaagattaaatgagaccatgcgcatctttaactctgtgcctggtacatgataaaaacccaggaaacattggttcctttcttcttagtaataataaaagaatatttattgaggccgtcagccactacactgagcattctacatgcttcatcacatttaaccttacaacagctccatgaagttggcacttactatccccaacttacaaatgagaagactgaggcctagaaagatggagtcacttgcttaagaatgcatttgagctaagctgtagagctaaggttttaactccaaatcctgccttacccattggctaagtatagccccactggccaatctgctaattcgggggggctcagtccacttattcattgagcaaatattattgggtacatactatgttttaggtactttatgaattgctgaagatgcaatgatgagtaaagcaaacatgactttcatcctcatggaactcacaacctagtccagggtttttcaactttggtgctattgacatttggggctggacaattccttgttatggggactgctgtcctatgcattgtaggatgtttagcagcatctctggtttccacccactagatgttaagagcaagaccttccccaacccaagttgtgacaataaaaaatgtctccagacattgtcaaatgcttcctgaggaaggggtggggggtgtgtgaaatgagaaccactgcttaatattgtgaatacaatattaaacattaagaggtttgtgcctaaaaaattagggaacctctacttagcctggggaagcaagggaaatctagggtctcttgtaaaatacagtgtctttctagaaaagtaaaaataatcatagttgatatggtttggctgtgtccctacccaaatctcatgttgaattgtagctcccataatccccacatgtcatgggagggacctggtgggaggaaactgaatcatgggggtagttacacccatgctgctgttctcgtgatagtgaattctcacgagatctgatggttttataaagcgtttttcccccttttgcttggcacttctcattgctgccaccaggtgaagaaggatgtgtttgcttccctttccactatgattgtaagtttcctcaggcctcccccagctatgctgaactgtgagtcaattaaacctatttcctttataaattaccccatcttgggtatgtctttattagcagcataagaatggactattacaatagtcatataccataatgtagagtctgacatacaaccaccacctcacaaaaagttttcacattattttattgaaaacgttcctgaaactatctctagtttagaaaaggaagccaatcaaattttctcaatagaaatatgttttatagtcaacttatccaaaacagggtgtaccgtgcattactatgttttcaaaagaaaatcaaggattataaagacatagtgactcataattgggtctaactatagcattataattgtgtaggtgaggaaagcatgcaatttgagaaggctagaatcaaggtcttgctaggtttgatatgtccaggtttatcacagtgttttcaggttgatgatgttgttacttctggcaggttaactcttgcgatctaaaatttacacaacaaaaattttatttcttgttcatgcaatagtcccacatggatgatcctggtttttcaggtcttctgagaggcttccctctacacagcaactcatagacctgaacttcaacaatcttatggctctgccttcctttaggtacttggagttcttgccttcaccgcggaaggggaagaaagaatatggggactgcaatggaatttttacagaccatgactagaattctgatattccattggtttaaaactcagtcacatgactaccactaaatgcaagggaggctgaaaaatagaatccaggtgtgtgtctagaagagaagggaggactgtttggtgaacatccagctatactttgccaatatgatcaaaatcactttcattgccaaaaagccataccttatctaattttcagatttataaaatcaggattgataaaatcagaaatattctgtgaggactaatgaaagatatataacttacattcttcccaaagaccttgtgctatgtatgtatctgatacctggagaataatgcactatgctaatttatagctccgttatgaatagacacatttttaatctgtggcagacatgatgtagtcaatctgttatcattcattagagaaaggagaatgtgctttgcggcccagagttcatgtcccccagcactggtgtaatattttcttttgctctcaatgtgtgaattattaaaaataagctagctacaatgtcatcatttttgattatatcaaaaaagaaggcagagacagggctgcttccaatctgtgaagttatttagcatttaatattcccttcgggaaatcaatatgatttgggggagattatttatataccactagtcaagtgtggtttaaataaatgtaccgtgttggtagagccatgtgaatgaatcttcaatgtcaagaccttactattgtataaagagatgttatcataaatcagctaaaaggaaaatggttagtaaaaattatctggtcattttcctgatatagatgactatattaggttctgtttttctggtatttgttcaaatcataaaaatgaatgtctgggcactgtataccacacattaacatttattagttatttaaaatgtatattctatgaaacttattttattttggggaagtgaaatatgggctggtagttcagacaggtatacataattcatgattttttaaccagttaagtaaaaaagaattaactgaatggtaacaaaataactcccactgttaagcagtcagggtgcattctgcataattcaggatacaaatcaattccttccaggcttgatggaagttcagagcagaggaggatggttaccagggcaaaaagaaaaggggaaatgagggggcaaaaagaaaaggggaaatgagggaagtctagggtctctgagctaagccacacattggttagcttctccgtaggccgcttcactggaatcctgactcctattacaggaaacagaaattcctgggagaaacaagacaaaagtgcaactaaagggatggactcttccaaagcaacctcgagggtgtatgcggagtgagagcctgcaagcctcacttgaaacagagggtccacactggctttcgttttctctatttagctggttctcagaaacaaagggtatatcctgctttaaacaactagagcatggaaccagaggaatacattatttggttattaccaaatttacaaagggattccactccttatccagacattcactataaaatgaatatctagtgaattttccctggagccaacaaaaaacattttggcttacaaaaattattttcacatatttaggttgaaccatatggaattgtggatatctgatcatttgtgactagcaaaaatggcagtttcttaaggttaaccttaagatctagctttctaggaacatatcctttgtataaagtaagatgcgtcctgctgagaaactttacaatacatctgatggggagacattttaatggtgtaaaataattcaaagggtattatttcaaggttcaaaaatctccaatgttctgacttccaactctctttggtatgagtgctcaagaagtttttaacctaaaagttgacattgtccaatcattaagtgattgggccaatttgcaacaacagcaataaccaaaaaggtagatcagtcattggcttcaaaaaagaacaagaagttgttagctagttgttagctgatggtatctttccttttccactgttagaaatatcatgtgtgcaatgaactgcatggttgttattatagagttccgggtcttttaatatctgggagagacagaacagcaggcttcaggcgggttaggcgagttttgccctttctggctcatttgtctaagaaagaatttggtgacttgacaagtttctagaagtagatgaatattacttgagtgaatgcagccagaggcagttagcaaattctgaccaccatcatagttgtcacccactgaaattgaaacttgagtccaaatttatacaagtggattcacttacgtggtacagaattcacatgctgtttattaactatcactgggtccttttttctgaaccctgtacatttttggatggcatgatattttggtagttgtaatcctcttgtgacaggttataaaagccagttaaaactttcttgttttgttctaactcagtatacccagctttaattgcaatgacgattttgattcaaaagacaaacttcaggaaaggaagtgaaaaagtcagcaagtctggagaaggttggaagagggagtgtgtgtaggatgtggggagagagaaagacagcagattcttcttcttttttaaaggaattattcacttctaaatgagacagctcattttaactgccccgaatttatgggtctagccattgggggaagattatgtgtctggggttgtctggggaaagaagctacctggcggtccaacattcacggtcaattgttattacaggtgtgggaacttgttgctggcaatgagagaattcctagggcaggaaattcagatgggggttggttcattgatggggtggtcaggaggcagccaaagccctctgccagtaatgggtttaggtagctactggagctagtattttctgctctgtagtttagaaggatgccacaatccaacatttctctatagaaatgcatggcctatttcatgtatccattgactttattttgcccagcagttacactcaaataacaagcaggcaatattttctttatagacaaattggcttatactgggttatagtaattaataagttacatatattacataatcacataatcaataagttacataaattaataagtacatatattatatatatatatatggatggagaaattactttttaaaaaacttgtacctatttgtaatcccaccaaccaaatgagagttattagcttgttttgagagattccagccaggccactcttactttggaggagaccagggcatattccccaaattctttccttctttcctttcttcctttatccctccctcttgctgacaaacattgactgatcacattcaaacactggacacaaagtcttcaatcacattagtcagcatgtgtgggagagtaaaaatatcatatgttctcttattttgtcttcttacataatccatataaatatcatagaaaattccaacatgctgactttcaatccccctttcccagatgcttttcacatctggaagtcacacaaattcttgtgtcagaccatgctcctcaattttgctctggaaatattgtcaccataactgtgggagacagaaaccggccatgtcttttctttagcctgactgccgcactcattaaatggctcttcatcttttctcctcctcaatgatggcactatggtgcctcctcttcacatccccaccccccagcctcaggtttaggcagtgaagagacaagagtgcatggttatgcagtggaaccttttagtacccttcctcccttacttcagactctgtattgtattaatgagctattgtcatggtgctttaagaagccaggatgaacaacagccttcttgtcaaggaaagtgacagtcaattaatgaaggttttctgtattgttttaagtaggaaagcctccaaatagcttttcaattggtgagaggaacttcagagctcaccctcgttccagaatactctgacaagtttcaaattattaatggacctctttcaggcctctgtaaatttgggcttttatagtgtctactaaagccaagcaaactgctccaataattataagttaataaaacacattgaggtgtatatgacatgaaacatgattaaaacactcccagccatattgatcccatatacaataggaacagttcaggaattctggctgtgcctctttcaagtagcccaaagtaaaattacactgtatttcaattgtggttttcatctcctttcatgattttcccctcttagaaaaaaagagaaggagcaaatattaggatcatcaagttgatgaattaaagaatcaagatgcaataggcagtgtataaaggtttgtagtgaccagctgttgaaagtgaagctcaagtgcattatagtggcatgttcttacgaatgtatcttctaatgcttttctatattttagtgacctgtgaatgatttaatgcagtgggtctcaacaaggggttattttttccctgcaaaggacatctggcaatgtctagaacatttttggttaccacaactcagtgggagaagagtgttactggcatccactgggtagaggacagaaatgctgctacacaatatgcaggacagcctcccacactaaagaattaccggccccaattatcgataatgccaaggttgagaaactctgatttatgtacatccaattcagtttgttggattcaaagtccatatttaaataattatttcaagcattatcagcagtgacagttaaaagtaggtagtctgacatgagtagggaaggagagggtcccctttacccccaggaatgtcaggtgaccatcaggtgatggtcaggcagttgttaactgtctctctaaaatgatacctggtcacaactggcagcggggaaagggagcctcccaatagatagaaaacacctgaggctgatgatcagcgcttcctgataagatctcaggagttgggcaagtgggttcaagcatgtacaataagaggcaaaatggtggagtttaatgggtatatgaccttcttttaggaatgcgggactggtaagggaagaacacctcaagtgagcatgtgcacaatttcagcaaactcactgcgtatatggcccctcctaagtgctggcaggtcaccgtgcaagcagacagcccactccaagggaagaatcagaggagaagaaatacaaaccctggaaccaagccaatgtataaaaccccaagtcaagggccaaatggggcacttggatctctcaagtcacccacttggtcctcttccaagtgtactttgcttcctttcattcctgctctaaaatctttaaactttcacttctgctctcaaaatgtggttctctcagcaggagcatcacctgggaaattgttagaaatacagattctggagccccactccagacatacagaatcagaaactctagggtatgttcactatgctttatttattatttcttttctttctttcttttttattttttgagatggagtcttgctctgttgcccaggctggagtgcagtggcgtgatctcggctcaccacaacctctgcctcccaggttcaagcgattctcctgcctcagcctcctgagtagctggggttaaaggcacgtgccaccacacccggctaatttttgtatttttagtagagacggggtttcactatgttagccaggctggtctcgatctcctgaccttgtgatccacccaccttggcctcccaaagtgctgggattacagttgtgagccaccacacccggccagcaatctgtgatttaacaagtcatctaggtgatgctaatgcatgctcaagtttgagaaccacgcccggcctagttcactgtgctttaaatcttccaggtgttgctgataacatgcccaaattcaaaaccactgctttagctgaaaagtggtagagagatagagagggacacagagaaatagagaaggagattttttttttttttttgagacaggatctcgctctctggtccaggttagagtgcagtggcaccatcatgggtcactgcagcctagacctccagtgctcaggcagtcctcccacctcagcctcccaagtagctggaactacaggcatgcactaccatgcccagctaattttttaaaaacatttttgtagaaacagggttttgccatgttgcccaggctggtctcaaactcctgggctcaagcaatcctcccgccttggcatcccaaagtgctgggattacaggcgtgagccactgtgcctgaaagagaatttttaaaggaagttctaggtttgcactactcaacaacaaaccaagacaaccctttaacctcaacaactttaactaaagatataaagtttgggttggagtttcactttgagtctcacagatgtgtagagttcaagcccactagttgagatggtccaaagaggttcagaacttaagtgttgtcatgtagtaagtgccaggccagggagagatggggcaccctctcttgatgaagtactccgggcatgtttactcttttcatgataaagagggctgtagctaattcttcctatcacctccaaatttatctcaatctcaagctttgaagaaatatcatcaggtatgtcagtatttacgtgccctatgacagcgggactgagaacatggaggaaagcaaatgtcctgtttccagttaccactgcagcaccattaaagcacctctgctttaatcatccattcttcgactgtattcagaacacttggaattttacactctggcagaattccctcttacaggctccatagcaagatgcttttcctttgcatgttcaaaaaactattcttaaaagaaaacaaaaatacaattgaaaggtggggagaaagccttctttgtgctggtcatttggaatgcaaacaatcagaaatgttcattagcatgccagcagcccaggcccctgcaagaagcatgctttcctggaggcacagcttagagcgaagcctgggttaaagttgagtgggagagagtattgaggaccctcaatcccaaagggagccctaaatcctgtggctgttgagcctggaaacttatatagctcactgtggcctgtgtgccaaaatcaagaactcctcttctaaaagattcatctttgacagttgctgatcttgtgtagcactagcagagcctctttaaaattcgtgtgagatctacttttgttaatcgaatctggaacattttaatatgctttgcatttcaattgtattagcagtatttcttatttaactgtagctcatgcttactgatagccatggataaaagtaagtcacatgtagcatgccaattgtctcatttgataatactccaaacataacgaaaagagaatgaaaatgaagcaacgtctggtagggcttgaaaatattttatatccaaggagcctgccaaaatgttaacataagggaacaatatcatcagacaaaagaaaaaataactactaaagcaactagtgacaatatgtagaatgccgagctttgtttaaaaaaataaaattctaccactaacatacaacaatttcaaaaagtgtttattgttctaatttcactccaatcaagacataatatttccttttgtatactgtacatattgcagttttttaaagaaataatttaattggcatgcaatagaaagttattctcttcttaaaaatgaagttgggagggtggagccaagatggccaaataggaacagctccagtctacagctcccagcatgagcaacgcagaagacgaatgatttctgcatttccaactgaggtaccaggtgcatctcactggggattgttggacagtgggtgcaggacagtgggtgcagtgcaccgagcctgagctgaagcagggcgaggcatcacctcacccgggaagcgcaaggggttggggaattccctttcctagccaaggaaaggggtgactgatggcacctggaaaatcgggttactcccaccctaatactgtgcttttccaatggtcttagcaaacggcacaccaggagattatatcccatgcctggctcggagggtcctacgcccacggagcctcactcattgctagcacagcagtctgagatcaaactgcaaggtggcagcgaggctgggggaggggcgcctgtcattgctgaggcttgagtaggtaaacaaagcagtcaagaaactcgaactgggtggagcccaccgcagctcaaggaggcctgcttgcctctgtagactccacctctaggggcagggcatagccaaacaaaaggcagtagaaacctctgcagacttaaatgtccctgtctgacagctttgaagagagtagcggttctcccagcgcacagcttgagatctgagaacggacagactgcctcctcaagtgggtccttgacccccaagtagcctaactgggaggcaccccccagtaggggcagactgacacctcacacagccaggtactcctctgagacaaaacttccagaggagcgatcaggcagcaacatttgctgttcaccaatatccactgttctgcagcctctgctgctgatacccaggcaaacaggatctggagtggacctccagcaaactccaacagacctgcagctgagggtcctgtctgttagaaggaaaactaacaaacagaaaggacatccacaccaaaaccccatctgtacgtcaccatcatcaaagaccaaaggtagataaaaccacaaagatggggaaaaaacagagcagaaaaactgaaaaatctaaaaatcaagcacctctcctcctacaaaggaatgcggctcctcaccagcaatggaacaaagctgcatggagaatgattttgacgagttgagagaagaaggcttcagacgatcagactactccgacctaaaggaggaagttcgaacccatggcaaaaaagttaaaaaccttgaaaaaagattagacgaatggctgactagaataaccaatgcagagaagtccttaaaggacctgatggagctgaaaaccacggcatgagatctacgtgatgaatgcacaagcctcagcagctgatttgatcaactggaagaaagggtatcagtgatggaagatcaaatgaatgaaatgaagtgagaagagaagtttagagaaaaaagaataaaaagaaatgaacaaagcctccaagaaacatgggactatgtgaaaagaccaaatctacatctgattggtgtacctgaaagtgacggggagaatggaaccaagttggaaaacactctgcaggatattatccaggagaacttccccaatctagcaaggcaggccaacattcaaattcaggaaatacagagaatgccacaaagatactcctcgagaagagcaactccaagacacataattgtcagattcaccaaagttgaaatgaaggaaaaaacgttaagggcagccagagagaaaggtcgggttacccacaaagggaagcccatcaaactaacagctgatctctcggcagaaactctacaagccagaagagtgtgggggccaatattcaacattcttaaagaaaagaattttcaacccagaatttcatatccagccaaactaagcttcacaagtgaaggagaaataaaaccctttacagacaagcaaatgctgagagattttgtcaccaccaggcctgccctaaaagagctcctgaaggaagcactaaacatggaaaggaaaaaccggtaccagccactgcaaaaacatgccaaattgtaaagaccatcaaggctaggaagaaactgcatcaactaacgagcaaaataaccagctaatatcattatgacaggatcaaattcacacataacaatattaaccttaaatgtaaatgggctaaatgccccaattaaaagacacagactggcaaattcgataaagagtcaagactcatcagtgtgctgcattcaggagacccatctcacgtgcagagatacacataggctcaaaataaagggatggaggaagatctaccaagcaaatggaaaaaaaaaaaaaggcaggggttgcaatcctagtctctgataaaacagactttaaaccaacaaagatcaaaagagacaaagaaggccattacataatggtaaagggatcaattcaacaagcagagctaactatcctaaatatatatgcacccaatacaggagcacccagattcataaagcaagtccttagagacctacaaagagacttagactcccacacaataataatgggagactttaacaccccactgtcaacattagacagaccaacgagacagaaagttaacaaggatatccaggaactgaactcagctctgcaccaagcggacctaatagacatctacagaactctccaccccaaatcaacagaatatacattttttttggcaccacaccacacctattccaaaattgaccacatacttggaagtaaagctctcctcagcaaatgtaaaagaacagaaattataacaaactatctctcagaccacagtgcaatcaaactagaactcaggattaagaaactcactcaaaaccgctcaactaaatggaaactgaacaacctgctcctgaatgactactgggtacataatgaaataaaggcagaaataaagatgttctttggaaaaaatgagaacaaagacacaacataccagaatctctgggacacattcaaagcagtgtgtagagggaaatttatagcactaaatgcccacaagagaaagcaggaaagatctaaaattgacaccctaacatcacaattaaatgaactagaaaagcaagagcaaacacattcaaaagctagcagaaggcaagaaataactaagatcagagcagaacagaaagaaatggagacacaaaaagcccttcaaaaaatcaatgaagccaggagctggttttttgaaaagatcaacaaaattgatagactcctagcacgactaataaagaagaaaagagagaagaatcaaatagacacaattaaaaatgataaaggggatatcaccactgatcccacagaaatacaaactaccatcagagaatactacaaacacctctatgcaaataaactagaaaatccggaagaaatggataaattccttgacacatacactctcccaagactaaaccaggaagaagttgaatctctgaatagaccaataacaggatctgaaattgaggcaataattaatagcttaccaaccaaaaaaagtccaggaacagatggattcacagccgaattctaccagaggtacaaggaggagctagtaccattccttttgaaacgattccaatcaatagaaaaagagggaatcctccctaactcattttatgaggccagcatcatcctgataccaaagcatggcagagacacaacaaaaaaagagaattttagaccaatatacctgatgaacatcgatgcaaaaatcctcaataaaatactggcaaaccgaatccagcagcacatcaaaaagcttatccactatgatcaagtgggcttcatccctgggatgcaaggcaggttcaacatacgcaaatcaataaatgtaatccagcatataaacagaaccaaagaaaaaaccacatgattatctcaatagatgcagaaaaggcctttgacaaaattcaacaacccttcatgctaaaaactctcaataaattaggtattgatgggacgtatctcaaaataataagagctatttatgacaaagccacagccaatatcatactgaatgggcaaaaactggaagcattccctctgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtgtatctagaaaaccccatcgtctcagcccaaaatctccttaagctgataagcaacttcagcaaagtctcaggatacaaaatcaatgtgcaaaaaccacaagcattcttatacaccaataacagacaaacagagagccaaatcatgagtgaactcccattcacaattgcttcaaagagaataaaaaacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggtcatactgcccaaggtaatttatagattcaatgccatccccatcaagctaccaatgactttcttcacagaattggaaaaaattactttaaagttcatatggaaccaaaaaagagcccgcatcaccaagtcaatcctaagccaaaagaacaaagctggaggcatcatgctacctgacttcaaactatactacaaggctacagtaaccaaaacagcatgatactggtaccaaaacagagatacagaccaatggaacagaacagggccctcagaaataatgctgcatatctacaactatctcatctttgacaaacctgacaaaaacaagaaatggggaaaggattccctatttaataaatggtgctgggaaaactggctagtcatatgtagaaagctgaaactgcatcccttccttacaccttatactaaaattaattcaagatggattaaagatttaaatgttagacctaacaccataaaaaccctagaagaaaacctaggcaataccattcaggacataggcatgggcaaggacttcatgtctacaacaccaaaagcaatggcaacaaaagcgaaaattgacaaatgggatccaattaaactaaagagcttctgcacagcaaaagaaattaccatcagagtgaacaggcaacctacagaatgggagaaaatttttgcaacctactcatctgacaaagggctaatatccagaatctacaatgaactcaaacaaatttacaagaaaaaaacaaagaaccccatcaaaaagtgggcaaagaatatgaacagacacttctcaaagaagacatttatgcagccaaaagacacatgaaaaaatgctcatcatcactggccatcagagaaatgcaaatcaaaaccacaatgagataccatctcacactagttagaatggcgatcattcaaaagtcaggaaacaacaggtgctggagaggatgtggagaaatagaaacacttttacactgttggtgggactgtaaactagctcaaccattgtggaagtcagtgtggcgattcctcagggagctagaactagaagtaccatttgacccagccatcccattactgggtatatacctaaaggattataaatcatgctgttataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccgaacaccgcatgttctcactcataggtgggaattgaacaatgagaacacatggacacaggaaggggaacatcacacaccagggcctgttgtggggtggggggaggcgggagggatagcattaggagatatacctaatgttaaatgacgagttaatgggtgcagcacgccaacatggcacatgtatacatatgtaacaaacctgcccgtggtgcatatgtaccctaaaacttaaagtataataaaaaaaagaaaaataaataaagaaaaatgaagttgggtgttaaggggttttcttgtgttaaacagaatattttccatacatatgtgtgtatgtgaatagatatatttctctgtatgtaatcagaactagaggtcaactttctctagtgtgaattaaagagtaattaatacaatactgtatcctttgggtcctttggattccaaaggaccaaagaagctgaggaataacagatttaagaggtttggatgttgcaaactcagataaattcatataaagtgtaattttgtgggtttctcacttatcagatctaaagacacagcattctttgctaatgtttcagtaacattcaactatcaataagtattttctatggtcattctgtgccgaaaacacagaatcaaatttctcccacctacagtacaatctggaatgtgaggattgtgggggcaaaaaacttccttaacaaatgatgctagcaaaaaccaataattgttttctcgggcaaaagggatttaaatctaaaaaaaaaaaaaaaactttctgaaaattaaagctaaatcattagttttgcactcaataaagaatacagccaagcatggtggcttgtgcctataatcccagatatttgagaggctgaggtgggaagatcgcttgaggccaggagtttaagaccaggctgggcaacatagcaagattactgtcactacaaaaagagaagaaaagaaagaagaagacgaccttcttctgcagggtacaggcttgctttttgggagattatgtgtagaaatatttccaaactgccaccaacatagttctttggccatctccttatatctctgaatgaatgtgtgattagaaaaagcatttttatgttatcctatgctaagtataattttaaaagcaagcatatggctgcaaaaaaaaaaatcacttaatagatgatgctacttatccagaggttgggagacaggagacataaatttctctaaagcttcttctagttctaacattttctttttctgtgtaaaacaatctcccccactaccttattctactggtgtgcatgttgatattataaagacacggcaaattattgaaatttgagtctcaaaaatgcatctaaggatatgagatgtgcctggatatttagcaatgctggctacttacttgttataaatcatctagagatattacaactttaaatagtccccaagggcaaaaatggccattccagtgggggaaagcaaaaatctaagacaaataggaattagtcaatcgtttctccccaaccaaaccagtgatgaaagctacaaaaaataccttccctggttgagaaacatcccgtcatttaaattgctgggttaatgaatatcggccttcaagaggaaaattgaaatgtattttatcacagactagtttatggatgtgtgtgtttatgatatcagcagaaatttctgagatgactgaagaactagctcaggaaatggccaagaacaaagggagacgaggccatcagaaacccaagccaaatcatgtcctgaaatttaagtttccgggcagaatcctctcttgcaattgctgacattgggagccccggtcggaactgcagaagctgctgcctctagaaagtttaagtatctttttcttgctaggtttgttattattactattttttcttatcagagaggttgtgtctcatggttgagaatttaaagaacctctttgctgaagttatgggtacgtccagtaccgatggaggtataatggtgccctctgctgggaagagtcagtaatgctacccagtgagttttctactgggcctgaagtaattttaggtgctggtggagggatgtcaagggtgtttctggaacaaaaagttccgagaagtactctgcaaaaaagtagttacaaaaccccaaaccacatgaaattagcttgattctgagttgacagtggaatctgaaaccagctgtatttcatcctaaaatgttagcgctataaacccttcatcaaacctggagacaattattttctcactatctggacaagaccacatttccagcggctgaatttttccagggccgactttgccttcccattttccttttgtagagctcccctcttgcagacttgcataaacaagcctcactcaagaatgaaagatgctatgaggctgagcccccatatgacattctgtaattttgctattaagaatcataaaaggaatttgtcacaaaaagtacacaccacactgacatgccttggctccttagaaatgcatagtaaggccaaatatcgatttttaaaatgtcatttcaggaagttcaggaaaactgcactatttcactaaaggtgtagtttcttatttttgagacggagtctcgctctgccgcccaggctggagtgcagtggcgcgatctccgctcactgcaagctccgcctcccgggttcacgccattctcctgcctcagcctccggagtagctgggactacaggcgcccgccaccgcgcccggctaatttttttgtatttttagtagagacgtggtttcaccgtggtctcgatctcctgacctcgtgatccgcctgcctcgacctcccaaagtgctgggattacaggcgtgagccaccgcgcccagctaaagatgtagtttcttacttcatttaccagttctggatccgcagccgaaatatttaaaccatctgtaacttaaagtagctaaaaaataactaaagggcagtaaaaggagactgtagccatgtattgcatgctaattgcacttctagtcaaaagcatactgttggctggaccatcttcagtggcatcttactctgtaagatattagggaaacatctgtttattgttattcatttattttgttgagacagggtctctctctgttgcccaggctggagtgcagtggtattatctcggctcactgcagcctcaacctaccgggttcaagcatcagccacctcagcttcccgagtagctggggctataggcacgcaccaccacacccggtaattttttgtattttgtagagacgggatttcaccttgttgcccaggctggtctcaaactcctgggctcaaatgatctatctgcctcagcctcccaaagtgttggaattatgggtgtgagccattgggcctcagcatgttgtttttgagtgttgtcagagtaagatgctgggttttccagggaagccagtgatgtctatctaaagtatgatgttcatcttgaaggagcttataatctaagaaaggagagaagacatgtatgggaatgatgagaattgattatagcatatgcagctgactatagtaattcaataaaagagacctggattctctgtagtttagaggatgagggcaagatctttcccaaccggaaaaaactctaaatgcctcttggatggggtgtcacttgagctgggactttcaagtagatttttaagtacttatttctctttggaaaaatagaaagataaataaaataaatagatgagcttttcctttttgccatctggcccaccttgtggttttactgttttatcttagttaccttggttgattttgaggttttaatcataggattccaatgctcttttactcaacatggagaaaaccatttgtttggggattgatttgtacaatgtattctgcaatactttagattctaaagaatgagggcgaatttttaaaaattggggacaggttcaatttgtgtgtctctctgcaaacctcgttcaagatgtcagatgaaacctgtgggggtattagctttctaaaggtgttgttccattatgctctagccttatagttattagttcagaacaatgggtctgaactccaaaactgtagcactgcacatttccctgcaaagagggacaattatgtcattggaatacagaagaaaacagcacttttttctcctcccaggaatgatgtcactgtgacactaagagtagcaaattcctatctagaaatccaactgtgttcacttcagagcactaaagaagctcagtgaataaaatcaggtgccagtcaaaagctatacttctttgtaccgctaggtgaagattgcatctctcaatttccccaagggctttcccagtaaacactccccttaaaagattcggttttgatgaaagaaaagagaacacaatagtattctctaagatatgatttaaaaattataaatatatttttcccgagggaaaaaactgcatgtaaccattttttaaattgacttttaaaagatattggccatgttacatattctatattaaaagattagtaaattaaaaaaaatctgtgtacattactgaacataaccacaatacatacttagggtcaatatgcttagaaaaaaggcctggtacggtggctcacgcctgtaatcccagcactttaggaggccaaagcaggtggatcacttgaggttaggagtttgagaccagcctggccaacatggtgaaaccccgtctctactgaaaatacaaaaatttgttgggcgtggtggggtgcacctgtaatcccagctacttgggaggctgaggcaggagaatcacttgaatccgggaggcagaggttgcagtgagctgagattgtgccactgcactagagcctaggcaacagagtcagattctgtcttaaaaagaagaaagaaagaaaaagaagaacttggtgcacaaaagaaataatacagacaataaacttggctgagtacccaaataagttttctttccttcactgtctcatagttactcttaagatgttctatatttcttgacctaagcctcctcaattctaatggaacaaggtagaagtttttttcttttaaaagccactatgtattttaagcgtctgatggtaggtaaggctgtgtaaataagacatatagtaaattatacgttctgagatttttcttttagccttattttatctaagccagatttctcactggatatttacatcagacccagtaagtagacacactctggatatcaactaagcaggatttgtcattctttacaaattgataaatttggcacactctgtatgatataattaacaacaatttcttttattattttcagaagctaaacatctaattctctgtgagggcaaagcagtaaacatttaatctaaattatttacatgtgctttgtgagaaaatcaaaataaaaaaagaggcatttctgacggtacaggttttatgactcaggttaagataaaaggttggggattttaggtattcagtctgtagcataaaatttagttgagtgtttctttctctgaggaaaaaaaaaaacagaataagagatacatctgactaaaaattatagccagtcctggttgaatgaaactactgtctggcagaatttatgagagcaaaataaaattgtatgagtgacaattggctttagaaaaggatggcataacagaaccaagtccaagaacagcagggtttacctttgccctcatttcccatcttaagaactgtggtggtatcacatgtttccaacttgagcgtcctggtccttgtaaccactatacttcagcattctggcaactcgctgacccacatttttggtggccaaactgtggttagtgtgggccaaggagccatgaactgctgactaaactctttctgaagcttgtggctacacaggaatcagtgggcaaagattgcattcctcttttctgcctgtggcgtatgacaaagtgggactgggaagggctacagctagcaaatattccaagactactttcttgattcagatggaatgctctgaagagctgaagcaaagaacaaagtcttcagtcaaatctccatttatgtaatgtctctgttatatggcagaatgaagacccatgctgtttctatctcatcatgatttttatttttttatttttatttttttgagacggagtttcactcttgttgcccaggctggagtgcaatggcacaatctcagctcactacaacctcctcctcctgggttcaagtgattctcttgcctcagcctcccaagtagctgggaccacaggtgcctgccaccatgcccggctaatttttgtattttctttcagtagagatggagtttcaccatgttggccaggctggtgtcaaactcctgacctcaggtgatcctcccgcctcagcctcccaaagtgctgggatgacaggcgtgagccactgtgcccagcctcatcattatgatttttaaattcttccctttgaattataaaggattagtccatcagagctatgtatagatgcaaattaaatgaaacatttgtcttaactctgctaaattagagggaacttcgcaattttttttcaagacttgagagaatcatcattctaatatccaaagcagtgattctcaaagtgtggtccctgaaccagcagtagcagcaggaagggagggagagagagcaaggatgcatagaaatgcagattcccagactctaactgacttctactgaatctgagctctgaggccagcaacctgcattttaataagccttccatgggatgctcttgaatgctcaatttgagaaccactgatctaaagaacccttgcaggggtgacttctgtgagaataagcagtgctggcctttcctgggaaatgtgcagcttgctatgtgttatcagggacacttcaactttgtattttgcccatgaaatcgtaacactctagtttagatgaagaaaataagtgatctgccacctcaaattctattagttgacttgttcaaacttgaattccgaaatattttcttaaaaccccaaagcacaaaatgtaatttgtattattgagtggttctttggaccatcttctgcacatggtaactggtttctgtgtaagtgaagtgtttctgtgtaagtgaagtgtttattgtctcctagaaataaatatttcataggcttaaagaattttagaggtggatggatctttaaaactcatcaacttttccccccccaggaaaaaacgtaggctgcaatatggcacctacaagagtttaggcagaaagatcttcctgagttccatgggagtgggtggccagctgctgagctgtgactttctctgttggaatctgaaagcaggagctcatcttcatctcttccccctccttccacatcacacttcttggaacagtgttgacacagttcaataaacgtttattgttaaataatacgaaatcaaatgtgtgctccttttcccccgctcctgcaggagggaaaaaggcattttgttccagtctgccagagggatgagtgagaatgaaaaataatgtttgcttctattatattaataggctacttttttaaaactactaagctagtagcctgtgatcctataaaatggcttccattaacaagaggagcaggacaacaaatggaaattatcaggaatgagatccgttggaaaggctatttggagatgtttgtgcagcacatgctcattactatgtctggcccaagtcaattttatttagcaccataaaaacagagttagcttatgatattttaagcatcttaaacaaagcaagatttatgctattgggtgtgactttgggccttcccctctacccggttttccacaggtctggaaaggcaagaaactgtttctttatgcattgcgagtataaagtaggaagcccccgccttctcccttctaatatcaccagcaatgaataggcagcgtgtttcccataattcagcaataactgggctattattctttaatgcttcagtttattaatgtaaccactgtgtcattcctaccatgcccgtgtaattaaattacccgacagacatttgataggaacttctcaatccccacaaaagcccagaatttctatacccctttgtgagtccctaatgaatgggtggcacagacacttctgtcatccgtgctcactcactgtcctttcctgactgctctcctgtgtcacaggggcttgctcctgcagacaaactgggagccgttctaaaggagagggtcacatttccaacacagctaatgtaaggcatgctatcaccttcctctctctttgtcctgctaaagcagaggctgaccaaattaaattccaaaaccgtgtctgccacggtaaatccacggtgcattcttaaaccttggctaccgaatgctaatccttacttaagtcatgattctaaagggaaaatacactgaaaatttgctcaaaaattaaagcaatcacatgcctatccaaatatatcattctatgactttctgaaaaggaaaaaaaatacacttacaaattaaacgtttcatcctttaattttataaatgaagctataataatgaagcctcatccagatggtactcgaatccatcttggaaaaaggcttctgtgattatttataaaataatggacttttctaaaccactcaactggtcattttaaaatgctaatttcaaagcagtactctctattaatgttatagaacttagacatgaactcattaaaataatcaaaatagattttagagtaggacttctttcatttctagaaatggtactttagagactctagatgtttctaaagatttaaaaattcttggccgggggcggtggctcacgcctgtaatcccagcactttgggaggctgaggcgggcggatcacaaggtcaggagatcgaaaccatcctggttaacatggtgaaaccccgtctctactaaaaatacaaaaaattagccgggcgtggtggcgggcacctgtagtcccagctactctggaggctgaggcgagagaatggcgtgaacctggtaggcggaggttgcagtgagccgagatagtgccactgcactccagcctgggcaacagagcgagactccatctcaaaaaaaaaaaaataaataaatgaataaataaataaataaataaaattcttatattttacagttaacacaatacaatacaattaacctagtagatgtatttgttatgtagagtatagatttgaatacaaatctggatgcccaatttttgaatatttaaattacttgatctgtatatgacaagaagaatatgaggatatgtaagtgtatcgaaataaaaatcaagatctaattttaaaagctatttgcttttataagaaaaaagcatcaaatcaaagtatgtgatgcccagatcaagaagattgaaaatgcttctgacaaactaacattgtatttttaaaatttgtataaatttaagaggtacaagtttagttttggatatattgtgtagtggtgaagtctgggctttcagtgtaactatcactcaaatagtatcccatcactcaaatcgtaccgcaactaacctttcagatcagatacatctttttttttttttttttttttttctgagacggagtctcgctctgttgcccaggctggagtgcagtggcacgatctcggctcactgcaagctccgcctcccgtgttcacgccattctcctgcctcagcctcccgagtagctgggactacaggcgcccgccaccacgcccggctaattttttgtattttttttagtatagaaggggtttcaccgtattagccaggatggtctcgatctcctgacctcatgatccgcccacgtcggcctcccaaagtgctgggattacaggcgtgagccactgcgcccggcaagatcagatacttttgagaagaaatcacatcttattggaaattagataatttaaatctgactaaaatcagaataacaatttataattattactatcccttaatatggaaatttgtgttatctatatatgattaaaataactttaatgtatataatgtctcaagctcacagcagcacagaaaaaataattgagtttaaatcttgaaaatatttgagatgaaaagaatatttgtaattatttgtgactgtctgttattctcccaagaaagcaataaaggggtaaaaatcatctaaaacagaggggacacatggaaaacaaattgccaagcagtaggtctaatcctaagaatgccaacaattacattaaatataaagaaactaagcactccagtgaaaaggcagagagtgtcagactggataaaaagcaaagcgaaacaaaataaagcctaattttgcactgtgtacaagagatggacttaaagtataaagataaaaataggttaaataaacgaagatagaaaaaggtatatcatgcaaatacccagcatgagaaaattagcaggctgtattaatgtcaagtaaggtagtcaatgaatatcggcagaaacaaatcacaagggaaattagaaaatactttgaactgaatgaaaaagaaagctcagtatatcaaaatttgtgagatgtagcttaaagcacttcttagagggaaatttatagagttaaatgattataaaagaagcaaagtttaaaatcaatgatctaagtttacaccttaggtagctaatttaaaaagactaaattagggctgggggcggtggctcatgcctgtaatcctagcactttgggaggcccgaagcaggcagatcacctgaggtcaggagttcacaaccagcctggccaacatggcgaaaacaccgtctctattaaaaatacaaaaattagctgggcttggtggcgcatgcctgtaatcccagctactcaagaggctgaggcaggagaatcgcttgaatccgggaggtggaggttgcagtgagccgagatagtgccactgcactctgcactctgtcctgggcgacagagcaagaatctatcacaaaaaaaaaaaaaaaaaaaaaaaaaaaattcaacatacactcaatgatataaaactctctgtaaattaggaattgaaggcaattttaacaacctagtaaaggacatctatggaaaacctacagctcacatcatactttattatgagatattgaatactttcttccaaggtcaggaacaaggcaagaatgtctgctctaaccactgctgttcaacattatataccatagtcagtgcaataaagcaagaaaaataagtgacaaataaaaagacttaaaaggaaataagcttaacctttttaaaaacaattatgtaattgtttatatgaaaaattctaaggcatctactaaataattacactattaatgacattttaacacatcagcatgcaagattaatataaaaatcatttgtatttctatattattgtagcagcatgaaatactggataatttatttaactaaagatatgcaaaatgtagattgaaaaccataaaatattgctgagagatattttaaaaggtagaaataaatggaggcatataccatgattagggattataaaattcaacattgctaaaatgtcaattctcccctaattgatctatagagtcaatacaacttcaattaaaagctttacaagttgttttgtagaaactgacaagttgattccaacatttatgtgaaaatgcaaaagaattagaacagccaaacaatccttaacagaataacaaagttaaagaacccatcctactctatttaaaaactaactataacatgacagtagctgacatcatttatttttggcttaaggacagattgagaccaaggaaacaaaatagagtccagaaatacattttcacatacatggtaagttgattttcttcttcttcttcttctttttttttttttttttttgagagggagtctcgcttatcgcccaggctggagttcagtggcgcgatctccgctcactgcaacctccacctcccgggttcatgccattctcctgtctcagcctcccgagtagctgggactacaggcgcctgccactgcgcccggctattttttgtatttttagtagagacggggtttcaccgtgttagccaggatggtctcgatctcctgacctcatgatctgcccgcctcagcctcccaaagtgctgggattacaggcgtgagccaccgcgcccggccggtaagttgattttcaataaagaggccaaggtaactaaatggggaaaagaatcatcatttcaataaatggtgctagaataactagataatcatttgagtaaaaaatgaaccctcacctctacctcacactacacacagtcattaatttgagatagatcataaacctaaacttaaaagcaaaagctagaaaacttctagaaaaaatcagaggcaaacatctcacaaccatagggcaggaaaattttttttagagagggtgcaaaatgtaataaacataaaagaaaaaataaaaattgtatttattataaattcaaaagttgtgcttatcaaaatacacttgaaaaatgaaaaggcaagctatacattgaaaagaatattgggaagactatcatacacacacagacatatacacacatatatctgacacagggcttggatatagaatatataaagtacccttaaaattcaataattaaaagacaactcaataaaaacgagcaaacatgtgaacagaaacttcttaatggaaggcatatgaattaccaataagcacagggaaatgtaaattaaaaccacagaaagtaccatttcatattcactggaatagcaaaaattaaaaagactgttatcaccaaatgttggtgaggatgtggagcaaccaaaataagttgcatacattgctggtgagagtgtaaaatggtacaagcagattggaaattggttttgtagtttctgctgtattcaaatgcatacctatgctgtgatctagaaattccactcctaagtatttacctaaatgaagtaaaagtatatgtcctcacgaagatttgtatacaaatgtgtagagtagctttattcataacagtcccaaactgtatagtgcccaaatgtccatcaaaaggtgaatgtaaaagacatgtgcacgcaaatgttctttgcagcactattcacaatagcaaagacatggaattattttaaatccccatcaatggtagattggacaaagaaaatgtggtacatacacaccatggaatactatgcaggtataaaaaagaatgagatcatgtattttgcgggaacatggatggagctgtaggctattattcttagcaaactaacgcaggaacagaaaaccaaatatcacatgttctctcttataagtgggagctaaatgatgagaactcatgaacataaagaaggaaacaacagatactggggtccacttgagggggaagggtgggaagagggagaggagcagaaaagaaaactattgggtattgggcttaattaatacctgggtgatgaaataatatgtacaacaaccccccatgacacgtgtttacctatgtaacaaaccttcacatatacccctgaatctaaaataaaagttaaaaaaaaaaaaaggtgaatggctaaaccagttgtggtagtttcatataacagaatactattgcgccataaaaaggaggaaacaacaggttcaggcaacaacataggtgaatctgaaaatatcacaccaagccaaagatgccagacacaaagagtagataggtatgagtccatgtctatggtggtgaaagtgagaaggaagggacacaaagaaagttttctggggttataacaatgtcctagtggttggggctgtcggtacatgggcatatgcattctttaaaactcataaaattgtgcacttaggatctgtgcatttcatcttatgtcaattttccctcaatatgttttggtgattcctagactgttcttctgagctcaggagtggctttggctgcatctttctcatagtgatgaattgtcagtcactgcctggctttttgaaattcaacagagcaagctcaggagtcaattgctaacaaaactgacttcccttcggtatctcttccctcctattttctaccaagagtcgattagacataatagggatttttatttttttattttttgagatggagtttcactcttgttgcccaggctggagtgcaatggcgcaatctcggctcactgcaacctccacctctcgggttcaagcaattttcctgcctcagcctcctgagtagttgggattataggcatgcgccactatgtccagctaattttgtatttttagtaaagatggggtttctccatgttggccaggccggtctcaaactcccaacctcaggtgatccgtctgcctcagcctcccaaagtgctgggattacaggcgtgagccaccgtgcctggcctatagggatttttaaacacactacacagtaaggtagtagcctttaacccaacgtagtttctctctttcttaatttgttcttgttgtttgtgtcatatgccttttttcttacactaaaagaaaatcttttatctgttgtctctaaacaaggttagggaatttttgttgaattttatgtataagtgagtatcaagttgaagttttgtttaaatttcttatccttcgaacttcaaaatattctgcctttaaaaacaaagaatccttgcatatacttctatatatgtatttttatttatttatttattttgagacagggtcttgctctgtcatccaggctggggtgcaatggtatgatcatgactcactgcagcctcagcctcctaggctcaagtgatcctcccctctcagcctcctgagtagctgggactacaggcatgtgccaccacatcctggttaagtttctaaaatattttcccctgcctcggtctcccaaagtgctgggattacaggcattagccactgcaccagcctatatagttatttataattttgaaggtacattgtcagagtgtgttaacttctgacattttcctagcctctaccatggagtaatattgtatattaattcaaatcagttgtcaaagagttagttatgatatctttaatctaaaattgttatatttttttcctgccttagcctccccagtagctgggactaccggcgcctgccaccacgcccggctaattttttgtattttttagtagagacggggtttcaccgtgttagccaggatggtctcaatctcctgacctcgtgatccgcccgcctcggcctcccaaagtgctcggattacaggagtgagtaaaattgttatctttaactactattctcacactgagtttgaaatctgagggttttgggggagtggatgggaggggttgtttttgaagcaacacttcacagttatctctattattgagattttctttgcaaagagcaaataaacattttctccaggatgttcatatgccatatttttttgttgttgttcaatactgcagctcccctgcctcaaagagactcaaacatgtggctgtttatacttgtctgggtctgatgatgaggggagtgttattttcaaggtcactaggctgtcttcagcccttggatacatggcaggcattggaagagacatgttgacatgtagacttagtccattaatgacaagaacttacaaacttctagattgtgagttttcttgcttgtgctaggcctaccttcatttccttatactaactaaaggattctttgagctatggcttattgcctttttcacctatttgtgagagctacttttaatgaaagtgcttaaatctaacttaacctaaaccaagaggtggcacagtatctttaaataaaatcagaaatgctcaaattcctcattttttatccctaaccatggttcatgataatgtcctaaaccttctctttatataattagatatttatatacaaccataggcttttgaggatttgtatgtgtatgtgcacaatatagattcacacatgtatagtttatatatataagatatatttttgtggaagtacatttatagagttattgtatttacattgtgtgtgtgtgtattctcacacaaatacatacgcacattcttataaaaactctctgtattttctctcaaggtttgggaaatagtcttagaatattgcttttcattctcaatcaagaagttagaaagagctaatgaaaaccttactttgaccccttcaaaaatatgcttaggaacaaacataagctccaaggatgagagtgatttgacaaattttctcaattcttgcaaaattgatttctgcagaaccaagcctatgcatcaaatatatacaccaggtccctgaaaaacaaggcactattatgctcaagggatgctagcaaagactcagtactttgtatcctcaaatctccttccctttggatggatcttgctgccccagttgccatgtttgattcatagatttgggccaaccccatgctgaaacatgccggccgcggccaatgccagagcctggaagagcaaatatcacagaaggtccatgtcacagtttcagaaatggcacctccgtagtattcactacataggatgcaaaatgggaatgcatgagacaggtgggaaagagagggagaaagaagaaagtgaaagggggtggggggagaggacaaagaaagaaagcagaggagagaaggaaagagaagagagaagaagggggatagagtggaaggaagggtgtcagagaggagggaggaaagtgaaggctggagaagaaaaaggagggaaagggttggcaaaaagatgggagaagagggatgcaagaaagcagaagtagaaagggaccagagagacagaaataaaattaagagagggatgaggagacaagaatactcttaaagaagaggaagatggaaaaagaggaagagaggtgccgaatgacagagaccaaggggggatagaaaagatgagaaagaaggaggctgtgcacatctgtgtggaccctgctagcagcttagccagtggcccagagcagcctcccagagcagcattggcatggccagtactgtgaggttgggtacccctgtcatcagtcccgggggctggtcctctcgagaaatgcaaatctcagagggccaggctcagacagttagcggtcatccccctaatcacctggctgcctttctgatctctgcacaagggccctcttgcaccgttaatgaattgtaaaaaacattatgttttccttcttctgttagggctcaggtttccagaagaaggaacaaacacataacaggaaatgctccagtaaagccagggagggcatgggtggaaagtagaggttgtaatcctaaagcagagccacccacagcagttctcattgcctttcctaaggtcacagtcacaccatctccttttggtaaacagaaggaggtcccacccaggaaggagtaagacccagtcatgaaaaacaaatgacaacagctctgagatcaggactcttcgtctggggtcttttttctctaggcagcctgtgggcatttcaactagaattatcaggtttagcaaatacacatacagatgcccacttcaatttgaattttagataaatcatgaataaagttttagtagaagaaatactgttttaggataagtatatcccatgcaaagagaggaagggagaaactctaaaaagagggggtaaaataagaagggggaggagaaacagagtggcagagacaaacaaatgcaatctctgggacatactgatactacagttatttgtttacctgaaacacaaattgaagttggtgtcctatattttatctggcagacatagtttcaggtctgtttttccccctaagttatttttctaacttatttttactaatttcattatttcatccaccctttttctatctattggttaatggtggatactaggatttcatcctcacagcatagcaattttctactaaaggcaaaaaaaaaaaaaagaaagaaagaaagaaagaaaaaaccctaaactctcatcctgtgtaccaaggtttattttgttttattttgctttcatactagcaccttccttgattcaagcgatattttgttaggaggaaaagtaaaacatttgcttctttgaataacagaaaacctggtgtgtgttgagaagcgggtcaattggttgaataaatttgttgagtgaagatccagagagcaaaaagaagattggggaagggcagttggggagatgagatggcacaattagatatgctgttcctgtgtgtgtcctgtgtgtgggtggcatggatcccctgtatctgaaagcatttgaaaggagctatatcactgccttccttgaggaatggtaagtaagaagtgagaacaaattatctctaagatcccatctaacttaaacctttttctggtattgatttttaaaataggcctatgtgtattaagagccttttctctagtccagtggaaaaattctatcatagagcttcatcattttgtagaatgtctcctatctgctctcagaaggaattagcacaagaaatttgggaatgaaagaaaatgattaagctaaaattttatactttccagcaaatattctcatagaatatcagggaactatctgggctttggaatgattcaatcatctcttggtgaagtgccaatgggttgggtggaatgtggaggttacaataggataaaattatggaaatgtatcaatggaagagtgaaaatgtaaagtgatgaagattttaaaaataactgggaaaagagtgtcctgacaccatggagaaacagaaaaccaattcgaattgaatggggcattgtttaaggtgaagtgtaatgtgtgctgtcccccttctccaaaatgtagactctcttttgtgagcatgtagccacaacattttagaactcagaaaagaattagccagaggctaggccttggagaatgggctgcatctgttttgaatactttcaatgccccaagcgtaggcattgacctcctgtcagacagggctccaaactgcaacccaagaagatatattgatctagaaaatgtttatacaactgcttatatatgtgaaaataaatcttctgttcccttggcacataagttaaagatattctagaaccatagcaccatcacatttttttttctttttcttttttgcgaactgggatgcaatacagcatctggggaaagataaatgaagaaaatccaatacatgaacagatgttactttacatttatgtggtatttcagactctacatatgacttggggttggctacacgtccacgtggaattttcccaacattgctatgaggtaggaatattaataacatttttcagataaggaaacaggaactcaagaagtgaagatccagccagggaccagtatcaggggttccgatgttgaagtaccatgcttttctcactccaccagaggtggcttggtgatgccatatgactgacggaaagtaaactgaactttacaaccttaatttgtccccagacaagttacagagcctaatgaaaaggagaaagaattgcaacacagtgattaattactgagttgtggcatgaaatccctgctccatcatttacttgcagtatgactttggaccagtttctttcctttctcagccttagtttttttgaactgtaaaacgggtttaataataatattttcttcaaggctgttgttaggattgaatatattcatatatataaagttcttattatagacatttccccacctgcacttattattattattgtatcaaggcgtggattctaactcttcttcagtgttaacttgcacattagtctaggatgttgcttgtgggcttttgtttgtaagcttgctctaagagatcaggcactttgaaaaaaaaaaggattaagaacttcaccaaaaagtaatttatcttaaagtctagccaaagaaatccatataaatatttcctaaccatttttgagaagtgggtaaaaggatcagaaatcaagtgtgacatgtggaaccaagcatattagcaactgatgtagcttggcttgcaggaaatgtgcaaaaaagagaaaagtttcattgtgatcgtgcaaaggagtatctgtgctttgtcaacatcaattttgtgtaatgcctttacatttctaaagcccaggagataaccttggactattaaagctaggattttgctgataggacattagaagatgaagcatttcatgacactgttatttaatttggagagaaaagatagactttggaaataaattaagactaccactttcaacactaagagggtcagagcaaggagaaattctggaaatgttttaggatcgtgagaggcttatacaccagggatctgtgtgcagacaggaagtgcagatcaagacagtagccttgggctctcggctgaaccctgaattaagtaagtgataacaacacaggacgagggcatgctttcttttcattcccctctttttttttttttaaatacattctttccttcttaggttaaaagaaagaagatttcagtccttgaaaacaatcttttttttttccacttattaagaacctagaggagaaaggcaattgtcccatgcctgtccactggggaaaggagacaactgttcataatttgctgagcttgcagcaggaacaccataaaattaaaccaagtagaagactaattccactgttggggacggggaaacattctagtaaagaagcaacttgtaaacttgtaaaatgagtcatataaagtgatgtctcaagaaaaataactagtgatatgtaatttaggaaatgtagatgcttcgtcattctaagaaaattactttatgaataaatgatactcaaggtcacagttgagtggcatgtctggaggtataagtggctaaaactagctgtacttaaagtaataaaaaagtatattatgtttctataaagctcttggtaataaaaatcagtaggaataagcaaacctaggaaacattttgaaataagagtaatttgatatggagacctcaattttccaactcaggtcctttttctccttttctgttcatgttgctaccacagcccctccctcgccccacctctccctttggctcaatgccctcatattccttatgccttctgtattcattaattcccaatctcagataggagtctgaaactccagcacctacagttataaaaactgacatgagatgatcatattttacctccccatttccagaattgcattttaataaagatcaaagattaatgctaaagtaatgatttcacatggcattcaggattgtggccagaaagtgggaatatggaggaaagggagtttgaggaagataggatcaataaaagggtcttaatgaaaacaaactacattgaaaaaaaatcccttttctacatatttgcaccaagggtactatgtgcttacttcagaaggtagagtttagcccttctaacaaccaaccaagttaaatctgcttttctcaaacagcaaagaaagacaattctctgcaatatcttattatggtttttctttgttagtatcttaaaaacactttaaatggtaaaagagaaattgcttgtggtttaaacatccagagggcaagatactttatcctcaactttttgatttcttcaaatacttacaaattattctcagtagaaaaattagacttattttcttcacaagtctatgagacagactacataacatcttaacataagtggccctgttgcatttcaaatatccagtcattggagcaattggttgattttggcagtctccatgactaatgcattaacttcaacctatcaaatgaactaaaaccaagtgtgtttgaatatttggtctacagataagcctactgggggcattcaaaccaatgagatagactcgacttttctggttctttcagactacattcaggggaacggttgcacaacagcttattagagccaagtcaaaaacatccatttcaaaagtcttcctttaaacaatatgctatctttgcattttgctaaattttgttacttgaaattaaaagctcattagaagcaagtcttccctgcaaactgacatattcgattacagtcatctgttctagagaacagactgcgtctagacagaagaataccgctgtggcttagaaggaacatgatgcgttacagcggctgattcttgggctgggtggttgtttttatgatctgcgttgggaacaccatgtgataaactattttgcagcttcccaaatgtgtataggtatgaacaacctcaatggctatagccataaacaaaacaagattgaattatggcaatgtggtggcgatgggggaaaacacattggccaaagataaatacgaaacggcggcattaaaaatgcaaaacaaaagcaaacaaaccaaaccagattaatacaaattaaagccaagagtctacgcttcatgggataaagaattctagcctttgttccatgttccaggatcttaacaactgtgtttagggcagggagtgtggagttatttattcacatgtacatggaatgggaacaagcaattggctgcttataagaattaagcatctgtcttgggaagcttcctctaaaacagagctgtactgagtgcataccatatgaaagcaaataggctaggggaatgctgttacagaaatttgtaagaaagcagtcttcatgtttttaaatgtttaggcttaaatgcatgtctagcctttcagcaagctacaacgcagtagagatgtttgatcttatgaagaatctcagtttaaatcaatttccttacagatgagtttacacatgcgataaatcacacatgctttgcaaagctattgccagtatgtaagaaaaggattctgctccacccccgccctgcaccccaccaacccttgaaattggtcatcattttgagactgaaaatgcaatcattgtcaattttctggtttccatggcttagaaatctgagaaggcaggggttcatttcttagtaaatttgccccctaggttagagaaggaagacgcaaatgaaaggagaggacatggctcatggtggttgctaagaaacatgcaactgaacacaggctgccccttaataatggccagagggggtgtgagctgtgataacatcggccatgatagctctgcctcctggcccagcaggggccactgctgtgggtaaaatgaaaaggaaggcagtcttgttagggaaaatgtaagaagacctggaaagggaaatgaaagcctgaggccctttgcacactgagatggtgctacaggtgccctgagggaaaaggcatgctttgtgttattttctactagtaatgaaggtggctgggattaggaatgattcacatgctgctacttgctcacctggtagctgacagctcttctttgaaagacctgggtcctgtgaattaatttatcaccctgttcttgacttaatgagcctcaacaaaaggagaaagggagcttagctctgaccaagtgagctaactagcccccaaatagctataatatagacatattatgccactgacatgatcagcacagcccagaagtccataatgcagtctctggggtctgggtgcaagtcctaatctttctagttggtgaccttgggtgagttacatacactccttaagccttggagtcctcattgtgtttaataggggcagaataatgtaacctacatgcatgcttattttcagcccgacgccacctctccctgtctactagcaacagactcccctctcttaattttagggaaatccctagccaacatatgtttccagaggggtctgccagtgagaatccaaacactcccaccaaaacccactccacttcagctacagtaattggtccaatggatgacaatgactcagaccaggctgatcagaatcctgccattgggatttaaaaactagattgaaataaaagttcaagtatgaccaggggaaacacttttttcccagtgatgaagctgctagagctactgttaaccacatttcctatcagtggataaagctggactacagaggaagagaatgacagtgacaagtaaagacatgcaaaaatggaagaatgaaactcttaaggtcatttgaatacctgactccagttcctgagttctccaggaccatcctggttctcacctcgcaaagatctagaggatgtttagatgagaaaatgcatgtaaatgcagtacagtgcctggtacagaagatttaataaatgtttaaattattactattgagtggggaagaatcattcttcctctctcatgcttggatgaaaaaattcttggaagagctgcttctccccacctcatttgttaactgagccccacagaaagtggcatgcccaggatgcaggaaagggggcacagtgtgactgcggagtggtgatctgcagccgagtggcattgctgacaagcagacatcaccctatcctaccatctgactcacagaagtaagttgcttcaattgcctagatgttccagcctccaaatggcctcattcttagctgtaaagaattccaagttttcaccaaattaaatgcaaacagtaaaaagagaagcgctcaacagaagcattacaaagatgaggttctggccctgcttctgccacttgtaagttaaaggcagagcgttatgtttgtagcaaccctttaagaagtggtaaaaatggagttttccatgtgtgtttacagcacttttgggaagatcacatcttttgacatgtgtgaactgtagagacattgagaatgtatgaagaattgttattattttcctagaggggcagagaagaattggtgttgtgactggggtcatttctacacatgtaaagaagggggttgaatcaaagatttagcccatcaattaacatattgagcatcttctgtgtgttacactgggttgtgttacaaccacggttcttgtgatgttcagagtctgttcaccgaaacagacccagagacgagaactaagagagcaatgaaatcccagaagaagaaacgatgacttaagtctgggaggaggccagggaaggagacacgaaagagctaatatttgatacgggttttgactgttcactgggtagagaagaggcggcattcctgagcagagataattatgctcaaggagtcaaggtggtgggaaagtgcagagtatgcttgggaagagccagagagacaatgtggattgtgactaaaacacaagatgtattgacgtagcagccttaaccttcttctggaacagacatagctaagggctgttgtactcctcgagatctcaatacaattgacttgataccttatggccacacccactaccaatttttaggcttgtgcaaatccaaaaccaagatttctgggaaattccagtgggtttctatttccaaggttgttcagctctctggaacatgcacattcgaccattgcctttttgatttttgcctgaaattctgcaccttcaatttctatcccaataaaatcattcacataccttaactcacattcctgagtttaggagtcttttctgaagattttggtctgtcaaattgcagccttccaccattttcctagccacacactctggtttcccattatagactcctttgggaatccaaattcttcttttctgtatgaggcagagaagaattatcttctgtccatctaggggcaaaacctgttcctccacttgtcttatgcccagtggtttagaaatggatttttgttgtttgaacaggcattttggatctcacagtccactttactttaataagtaagtattattattattatatatattacgattataatatatattatgtatattactattataaagtagcttaaaagctactttaataagtagcttattaaaaatacttctctaatgagaattccgatacctacaaaggtagtcacaagttttccatcactccacagacaagacaaaatttactaaatgaaaatagcgtgagttgctatggagaaggtgagaggtgatggaaagaagaaatggcttgggagagagtcgtggttgcacagccaacgctgttgatacccagctacgcagagggaggggagccattgaaggctttggaacttgggagtttggtgttcaatttatgtgttagtggggtcagcatgaagacaggttgaagactggatgtgatgggggagagactagacgaaggaagagcagtctgaggccatcataatagttgaggacagaactgatgaggattagcatgacagtgagagctcatgccgtggcagctggaaaatgagttctatagaaatctatgagtcagaggattcaaaaacattcacagctcattttcaattcaaatatttgtgaatttcaagggagagcaacccttccaaagttacagcctcatgtgctcatttaagtgatacacacattttcttaatcaggggaagggatatgagtaataaacttaatcaatgattggtgatttttgaaatcaattttgaatattatttcacatgttttaattttttagaagtctatttggtttgactatttgagacagtcatgaaaactttcttaggtctttttgtgatctcaaattcatctttgtcgtagcctattaatttactgcagacataactttccatttacctaataaatgacaatttgtgttgtgtgtttttaaaaattttctcctatgccttgaactcatttctgaatggaagtcttcctatctcattaacttccctgttgtgtgtatttagaatccactcattacgtgttccttctttccaaccccaaatttgtgaaaattcttttatgaaaagacatgcttatgcatttaagattacacatgccttctaaaaattcctcacattatatctatgctccttcaaaaccataagctacaaacactaggtctgatcatacaggggaaataagagggacttctttttctttctttctttcttttttttttctaggcatgtcaattttcaatcttctgggatccatttagtgagctggagatgataatggttcatgagatgctagcagcccaaatcattaggagcttatatagtctttctgtcctgggactaatatatttttgttgacaactggctccagcttctcccacccagctggcctttctcctgtttattgtccctggggcctccctcgaagcaaccctactgttctcaggccccagcccatctagcaggctgtcatgatgctcagacacagagtcagcagcagcagggctaggttcaattcccagcactcttccacaggatagagaacaattaaatgtgaaaactcacctttgatttattaggtatactttgtggagtctgaaatgaaacaagtcgagatagttcaagtctacattgctcacattaaagatttatatacaattccaaccaactcaggaaaaggtctgagctatagataactgcatatttataggttgttgatgtctttgcattgaggtaaacttttctcttaagttatatgaattaactgtaatgttgggtagtcatcacctgagaaatttattgttatgaattaatccgaccccaaaagctaggaggaactataatcattatgataaagtgattgaatggaagacaaaatagggttcagggagatgtaaaactaatttcaaggttatcaatatacgcattggtgattgtgtagcatgtatgcgatgtcatcccaaagaagaataacttaatctactgtgtgcagtagataatgggttgtaagctaaacaggggtctgacctctagtactttaaaccccattaattaaatctgtgccagggaaacctaggaaagcatgttagtatcatggatggggggacacacacaaatgctgtcataaggcaagatagtctttggtactgctattttaaggatcccttctttctactgcttctctgcagccagctctggaatgatgtatatttctcatttcttcagggtatattatttctggaaggttctaaggtcatccttgtgcatagctgcactgcatagtgtggagtgctttgtatatcttaattgccagaaatgcctttgttaatagcccactatctccctatcctctcttccaacattgtctgaaatttccatcaaggaggttcttccctgatatttgacaagacctaaaagagttttgtttccaagacactcataaactgcagacactacatggaagagtaaggcacaaatgggccaagcagagatgtcatcactagaaaggaatgagcctgaggagaagaccagcacgttgctgctcaaaatatagcccatggaccaacagcgtcagcatctcctgggagcttggtagaaacacagaacctcaaaccccaccctgctgagtcagagcatgccttttaccaggatggtttatgtgcacacgaaatttagtactcaccttgaagaaagaggggcagcactgttaggaacacagatggccaggccaagatgacacaagagatgattgaagattgtattaggctgcttttgcattgctataaagaaatacctgaggctgggtaacctataaagacaagaggtttgattggctcatggtcctacaggctgtacagaaagcatggtgccgatgtctgttcagcctcttgagtggcttcaggaagcttacagtcatacggaaagcaaaggggaagaagcacgtcacttggctaaagcaggagtgagagtgagaaagtgagaaagagggagaggcagggagatgccacacacttttaaacagtcagctcttgagagaagtcactatcacaaggacagcaccaaagagatggtgctaaaccattcatgagaagtccaccctcatgatccagttgcctccaaccagtccccacctccaatactggggattacaatccaacatgagatttgggcggggacacatatccaaactatatcaaagataaacaagctattttgccaaagactcttctggagcaatattctacccactggttcccaaagcagtttgaccatctgattcattgcttacaactatacatttcaagatcacaccccggagattcatatttcactgatctgaggaggggcccaagaacctccattttttagcaagcacctgggtgattttcctgtaactggctggtatttgaatcttctacagattcaactagctactcttcagcctcctgagtggtcacagaagttttcatactctaatctctaatgtgagcttagaaaaaaaagaccttgatatataaaaatcagaaggagatgagtcgtggaaggaactgctgcttgttctaagccaccattatgaattcctggccatcccaggcatggtggctcatgcctgtaaccccagccctctcggaggctgaggcaggcagatcacttgaggtcaggagtttgagaccagcctggccaacatggtgaaacccgtctctactaaaaatacaaaaattagctgggcatggtgggacgtgcctgtaatcccagctacttgggaggctgaggcacgagaattgctggaacctgggaggaggaggttgcagtgagctgagatcacgccactgcactccagcctgggtgatggagtgagactctgtctcgaaaaataaaaaataaaaaataaaaataaaataaaataaaataaattcccggccatcaatatcaggatgtggttgctgagtaatctagtaacattctcaagtctacggccattttcagacttgctacccacgaaaatctgaagttatagacctacatttggtgttgccctgactagagtaatccaagacagctgatgaggtgtgagtctttatttagaagcatatttgtgaacacgttgaggggaaaataaaacgatttagaatgtggggtgggcagagggttgtgtcctcagtatcacaatagtgcttgattctgttgttgtgatcttatcagaaaattataaaaatatctggccggttctggtggctcattcctataatcccagcactttgggaggctgagacaggcggatcacttggggtcaggagttcgaaaccagcttggccaacatggcaaaaccccgtctctaccaaaaatacaaaaactagctgggcgtgttggcgcaccccagtaattccagctactcgggaggctgaggtgggagaatcaattgaacccaggaggcggagattgcagtgagccgagattgcaccactgcactccagcctgggtgacagaacaagactccatctcaaaaaaaaaagaaagaaagaaaaaagaaaattataaaaaatatcaatgtagtgtacactgtttcacttagacatttcttaaaacaagggtcttggccaggcatggtggctcatgcctgtaatcctaacactttgggaggtcgaggtgggcaggtcacttgcacacaggagttcaagaccagcctgggcaacatgacaaaaccctgtctgtatgaaaaaatacaaaaattagctgggcatgcctgtggtcccagctactcaggaggctgacatgggaggatcgcttgagcccaagaggttgagccttcagtgagctaagatcatgccactgcactacagcctgggtgacagaggaggagaccttgtcaacaacaataacaacaccaatcaaccaaaccacaaaagggtcttcattgtctgaaataaaaaggaaatttcaagccccatttttggtcaactgtcagcatttgccctctttggcccctcttaaggtttcagaagaaacacccactgatatggtttagatattgtcccctccaaatctcatgccgaaatgtgacccccaatattggaggaacccagtaggaggtggatcatgcgggtggatcactcaagaatggcttagcactatccccttggtgataagtgactccttgctcagttagttcacatgagatctggttgtttaaaacagtctgggacctcccccttctctctcttgctccctctcttgccatgtgacatggctgctctcccttcctcttccaccatgactgtaagcttcctcaggccctcactggaagcagatgctggcaccatgcttcctgtacagcctgcagaactgtgagcctaaatacatttattttccctataaattacctagtctcaggtattcctttagagcaatgcaaacagactaacatgctcacctctccacagtgtccactcctctcctcaagtcataggaagccagggagcttctcttgtaaggaaacttgcttcacataccagcagagtttggaaatagttttctttactccaaagaagccaaggtaagaagtatagtgcagggggcaagcatgcgaattcttgtgtcagtctacctacttcgaatcctactcaattcttaaaagctatgacaccttaggcaggttacccagagttcctgtgcctcacattggtacctaaaaaatgggataatcataatacctgtgtcacagaactgttgagaggattaaatgagaaaatacagggccatctttctggtagataaagcattgtcaatctggtagatagccccaaatagcctatttgcctagaatcctgcaagagcccatggaagccaactgcctagataccttctttcttggcctccttattttccagatttctccatcccctgcatggaaactggtactcaagggtgacgttgctctgtagtgtagcctattaggtgaggacaggtttttctacctctcttgcttacctcatctctcagagtcttgaccctactatggttttctcttaaaaaaattcttgaaatgacttttctaatttcaagttataacacatctgaaattaacttgcccagttacaacacatctgaaattctaaaggcccttcccctacctgtcgtgcaaatccccttccgtctagtctctggcctaaaaccagttgagatggaccctcctcctcgggaagtcctgcctctttctgaaggcagggtgcctgctgaatctggtccctgtggccctgtttgctcaaatggcttctgcagttttaaggggaagttggaataagacatgtgaaaaggggagggtggaaactgaaatcttaaaagacaaaacaaatgagcactgagcccccagcttgcacatgtaaatccatgggaatcaaaggcttgcagaacggtggcagtagtcggctgtctaactgggaggatgaacagtatgctatgtgctgatttggctgaaaagactgtcttccctagtaagcaaattattgattataaactgttatgattccttcggagccattgtggccaaccatattattccatctgccttaaatgcctgctgtgttcccatgccaaaacccttatgaaatttccactggaaaaaaaaaatgagtagcaaattcaggtctcagtgctcatatataatttcagatttcattaatagttattaaatatatgccctgaggaaggataaagttcctcatatgaatggaaagagaattgaatttataaataaggtgattctgttttcaaggactgttcattagacacatccagtgcacacttcaaaaaaaaaaacatttaaatgaaaggtgtttaaaatctcacaggataaaaagcaatgcaatgttgggaaaagataggcttgctcaaaaaaattttaaaaatgactaattcggaaacatttctctctgcctggagtttgaaaatgaactttggggaaaattcaaaaaagttgtaaaatatttttatatcgtgtccccaaaatatccacatctagaaaatagtgatgcatgtattggtaggtggcaaactggatgctaaaagcatgttgaaaattggtattaatcttttttaaaagctacaattataaaaataataaaatagggtatttaagtaattttgactaagcgaagccctttgaagttttaggctactaagccacataacctggacaataacttctgtagtgggagttgtcaaaagtccaagtaaaaaattcaaatccttttcagacctgtcacaaatctcctgaaaagctgtacaaatggtgtagttctagcttaatgtgaataagcagatagagaaggtttgaaagagatatttaagttggcaaaagttcagaagaacagagtggttggtttggtttttgtttttgttttgttatgagggcaaataaaatatttgcctgagtgctgaattcctgaagagagatattgttgaactgaagacatttttggatcaggtgagttctcttatttccactgaattgtcttattagaaaagaatagacaagagagtttttttttgttttttgttttttgttttttttgtcatctgtcagcctgctggtacatcagctgccaccagagataaaacgtacagaataccttcagacgttgtgggttcaaatgttagcttttctcactgaaaaatgtactctgctatattttatgggaaaaaaatgctgttgtaaataaccttaacataactgttgaagcaatgaagacaatttttctatttgaattttatctcgtaagaccccctgaaatgaaattttatcttttaaaataaacacttcccaaacagagagagactgagatcaattaagccttccctcctgctttatcttgttttcatttcccgagtgagcgaggtgcactgtatgatggtgatgcgattagccgggtgtgtgggaccagagggccattttctatggccctgcaatctccatgatcagtctagggtctagggaacatttcccttggaaagttcacattacctcaagtgaaaagtctcgttattgaaaaacagtaattatttagttgcaaaatatattaaacataattcttatttttattgttttgctaggtagctaaattcaaagttgtcactaaacatatgaaaatgttgggttttatattacccttaaaatatgttttcgtataagtttgattctaagatatgtgatttttaccaggctgttgctcataccaacagtccaactccagagaacttgcaggaaaagtttgaaaaagtaatcctacagtgacattgatataaggggataagcaagaaaacgttagtgtaaatcctatttagctagttataagttggactgtggttgaagtttgtttgtagattgatgatttaaacagagatgctttggaaaaataagcaaagtccaaattcaaatatgtcccctgttaagacatagagaagtaaaagtgattcacggagaagattgcagaaaacaaaaatctacctccctctctagaacagtaacaaaagtagaaaaactgaagaatattgaaacattttcattttcccgtatatagattttttttttgttgttgttcaagagttgctgatgggagatagtaactaacctggcaatgagaatggaaaaatgaattgtaaaaaccaaacaaattaaatgtcagatgatgctttcatgtagcaaagggagttatctgtcattcctcgagaagcataagaaaaagaacagatttaccccctacttcatggcaaagacatttggtaaaaggcagactacagcatgactaaaacagaatctcaccaccccccaagccaggggtcgttatcgacagcataaaagctcaggtggcagctgtggaattccaaatgaactaagaaatgtggagcgagccaacctagttcagcgggaaagaatgtcaacaatttccccatggactcctgggagcctgttgtgagcacatctctttatagccttcagagaaacagaggcatatgaagaacagcccggggaactgagaaagagttccagaaagtttagaatgtcagagatggcccactgaagtaaagaaatatgagaacaaaattgaggtggggaaactggtggaaaggagacagtttgcttctgttttctgttgctaaatgctttcctgtgcttgcccgcccacatgctcacaacttatgaggaagcaagaaaagaagctgcactttgcaaaaaatatctaatgaatagaattctactctgtgatgtgaatctatcactaattttcttggtgacatgacaccaccttaagaaatgaaatgaacaagatatccaggacataatcacatttctctgtatatgcacacatacagcttcatatggacatgcaaaattaagagcatatagcatacggccacttatgacagggcatttctatagtccatataaattaagctcctttggaaggagaaaaaaatcccatgctacttatttatgcaagtgttttcaaataagtttctctatttgataagtgtaatgtaatcatacacaagcgagcaatgaaattagaaataaagacattgcatgttaggagcaaagtaggcaatttcataaggagcttttaattctgagagcatttcgaatggagtatttgaattgattttatctaattaatatgctaaattacagtgaacaaagaaagacaagtacaatcgtgtagggcatgtggacttgtagcatttccaagcagggaggacctttgggagtctccagtccaactccctcacttcacagacattcctaccatgtgaagtcacacacacaagctcgggtcaaggctacgtgtccagtcacttatgtatgcatcagaagggggagatagacacacactcaaacacacagagaaagaacatgaaaaacaatgcagcatacacttgtggcaatgtactctcctggaagaaaacatacaggttttgcagagaagagggattcatcagatataaagtcaggcctttatgttgtgggctgaaagctcaggtggcatatatagatttccagataagctaaaaatgacaagtgtgcagaattcacttgcaaaggctgccagcactttcccgggcattggacccaagttgcattgccatgttacctctctgttgtcctaagaaattgaaggtgctctcaccatgtttgaaaacctcccaaattaaaatcacctctatgacatgaataccaggagcaccaggtctcagtctccatagcattttcattgctccctgcatgcacccagacatcttagcatggtggtccttgaacttgggcatcagcctcagctggagggcttgccaaaacagattgttgggtttgaccccgtcagaattcctgactcagtaaatctgggtggggcctgagaatctgcatttctaacaagtgtccaggttgtgctgctgctagtgcaaggatcacacttggatccaacacactgcactagcacagcttaggtttgctgaaattggattaccgagttgacagatgaaaatgattctcttttattggaccacataatggatgtgtgcatctgtcacctgcagatgaaagtggtggcaaaatgtgaaatttctagcattgccatcaggaaaatattgacaagcatcattaggaaaattttccaaagcggggtttaaatgatctccatgtgcaagatcaatgggatggaacatcttttgaaaagttgtttcatcaatgaaaactaaaatgaatacttgctgcaattgctgaggtttatgcatgcagttccaagaagtgtggagaatttttaaaagtcattttttttggattaaattaagtatttctgaaactatctcattagaaaagaactttttcattattgaaactttacatctgaactcttactttttaaagtattacatagtttaagctggatgttctttttcttgggttttacttttcaacaggaaatggaactctatcgaaataaagaaataaatgttctgcttacatgtgctattctgaacaacgtagttatttataaaggggggtttctatttttactaactcaatatgtaccagaaaaaattaataatttaaatacagatttgaagacaactcaaaattttattaatcctaataatggttttaaaccatattaatgtacatcaattggtctcataagtcactttatttatttatttatttatttatttttgagacagggtcttactctgtcacccaggctggagtgcagtggcatgatctccgctttgcagcctccacttcccaggctcaagttatccttccacctcagcctcccaagcagctgggactacaggcatatgccagcatgccctgcttttttttttttttgttttgtattttttgtagagatggggttttgccatgttgcccaggctcgtctggaactcctgagctcaagcaatctgcccgtctcagcctcccaaagtactgggatttcaggtgtgagctactgcacctggcctcataattcactttatattttgcattaaaactagtttgtctatcaagacagatagaaagtgtccttgttctaaataggtttatttgttctccttattaccctcatctgaatctgtaggccactgacaaagagttttttcaggtctccaaatgactccatgttttcttgaaaccagtctttaaacagtactttttctttcttttctttcctttttttttttttttttttttttttgagacggagtctcgctctgtcgcccaggctggagtgcagtggcgtgatcttggctcactgcaagctccgcctcccaggttcatgccattctcctgcctcagcctccccagtagctgggactacagttgcccgccaccacgcccagctaatttttttgtatttttagtagagacggggtttcaccagtagagagatggtctcgatctcctgacctcatgatccgcccacctcagcctcccaaagtgctgggattacaggcttgagccaccgcgcccggcctttaaatagtactttttctgtgttgctctcctccaaatttaactaaaagggattttatgtcttgtttgtaagcttcaagaaaagctgcaaaaatttaaagaatacaaattagaaattatatcaatttaacaagcaaatgaagcaaacaatttaaaatctgaacacagtttattgctttttcaccggcaggcaaatgattatgttcccacagtgtaaactttcctattttgagtcttttatcctgtaaaacactaattcctttatcaggaggtcccaaatagaaaatactcctttttcaatggacattgacaacacgcatgtatgctattattacgcactgaaggtatagctgaactcatgcaatcttgctagtaatttcactttggagatttgtgataagatattgccatagaatgagactttgaagacatttagtcctaagcgagtgctgttactcaattttgcataacagtttcacatttgaaggagaccgaggaaatgctggcgacgcagggctgaggcacaactttgatgtggggcctcttggtagtgggccaagtggttctaattattttcagaactttctcttgcagtgggaaggagttggaaagaggatcacataggcgcacaaatctggttcccaaagtgaagtgagatgagaaacgcttctggtgatctatgccagtgacgggtgagataatcttccttccttcccctttgtgatgccactttcagcaggatgcttcttcctctgctcacctggagcgcctgtgacttctctctccctaggggacggggagggagtgccctgatgtttcttcactgcctccctggtcttcctctgaccccaccctccgccactcccccaaccccatttgtttcttagccacctctgtcatttacatcactgtgttgcctgccccatacaggaatctgcacccatttcatttgcacaagttcccattctcaactcctcttttcagggacaattcagcactcaagttctctagcataagaaatgcctgtgtggtttgtaaagcacaatttacaaacagatacaaaaaattttctaagcgagtgaattcagttgcttgatacattaggcaagaagaggccaaatgggaatctgggttggagttgtccgctgactcctgaggacactgatcttctcctagcggactctctcgcatagtcgctgctagctttgcacaagcctctcttccaggtacacataaactttgttgatgaaatcctcataccgttctgagaagcattttttccaaccaatctgattttggagttaaacacattgcatcaagtcgatcacaaattacacctgtgatagatcaatgctcagtgcctgacaatgtcctggatagtcagtcaagggcaggtgaaggcttgcactcggggggaagtaagagagcacactgccttttataaatctacaattgtgccaattctgcaatggttactgcatatactgctcacgtttctcttttcattcttctgctggtttgcttaattgaatccccctctctctaaagatataagaatgtaatatcacttacattctttatgccaaaactgtaaaatgccttttattttcttggatatgtctcagatagcaaagaaaatgaaaattttacatttcctttttatactgtccccacaaacatctcataaacatgcttttgcataggtataacttgcgaggggaagtattaatatggagttgtctttgtcttcaaaaaacaaaacaaggtcggggtgcagtggctcttgcctgtaatcctagcactttgggaggcagaagttggaggccaggagtttgagaccagcctgggcaacataaggaaaccccatctctaccaaaaataaaaaattagctggatgttatggtgcctgcctgtagttccagttactcaggaggctgaggcaggaggattgcttgagcctaggagttccatgctgcagtgagctatgattacaccatgtcactgcactctagcctgaacgacacagcaaaaccctgcctctaaaaacaaaacaaaacaaagacaaaaacaaaacggaaaaaccccatcattgccatagtgtctgttaatcactgtgacaagtccgtaattatcttgcttgctcttccagctgggtagaatctatagaatatttaaaccaatccatacctcccgccttgaaatgaattgtctaagctttgctatcatgttattttctatgctattactttattttctattaatgactgtatgagtgccttagaacagcaggaagttattatcttatcacacagctgatatcaaccattatctctcactcagaacaacagacagcaaggagatgattccttttaccaaaatgtaaggctaataatacatttaagtaaattgttaagagagtctaactatgtagatcccatgttcagctccttcattttacacacacacacacacacacatacacacacatctgtgcactaacgaattttctataggtgaagaatatgctgctttcctcaaatgtttatgcctttttaaatttaatcaatgatgcagtattcaactgggtaccaataaagttttgttctctgaccaagtacactggagtgctggaagattggccccaatccttcacctctccctgtatctcagccctttgccacagtacactgtgggcagggtgtacttctttgctccttgtcttggtcacatgacttgttttggcccatggaatgaagcagaagtgacagtgtacctatcctaaaccaaggcttcaagaggtcttatgtgttttcacttgttctctttcaaatttgctattgccataagaaggacatgcctgggctagcctgtccatacaaagaggaggatgacaaggacttagagtaaagctctccccatgccaagcccaggttagccaacacccagttgattggtagacttgggagacataagtgatagtttttctaagccactatgtatgaaggtagtttgttatggggaattaggtaactgatacagcattaagtcgccatcaggtgggtttggtttacagcattgattggtagtggttcatttcattagcttagttttaaatttgatataatgatacgttaatattactcagtataatcttaggagaatcataatagaaatagattggctttaactacagagccagatgactctatatttatagagagggaaaattcccttatctttcagaacttcgatgtttgcacatctgtaaaacaataattacaatatttaccttgaagggtaggaatccatggataaagtatgtgatctacccagcatatggcagaacaacaaataaatgttagctattatttttattcagtacaatctgtgagagaaagtctattaatacttgggtcattatttgtattcctttttcttttatttcttttaatgttttgctcattttcttccggttttacttatataactcttcgcttttccttgccttctgaaaaattcaagtataaagtctaccattctttttgcccagggtccaaaaggatgatttaccaaaaatggaaagacccactgagctatttatactgctctggacacaagtttcatcttatggacacatttccatcttatggacacatttccaaacacaaacacaaagtttgttgttgttgttgtgtgttttttttttttccaatatcggctcactgcagcctcaacctcctgggctcaagtgatcctcccacctcagccccccaagtagttgggaccacaggcacatgccactacacctggctaattttttgtattttttgtagagacaaggttttgccatgttgcccaggctggtctcaaactcctgagctcaagcgatccgcccgccttggcctcccaaagtgctaggattacaggtgtgagccactgtgcctggcctctaaacacaaagttcttttgaaggaaaatcaagcagagcagatcactaaacgtattccttaaatatgttctcttccctcccctatcctccataaaatcccacaaataagtatcagatataagtgagatgcttcctaatttaaacccatgatccactgtgtaggaagcaatgacaacagcaagacgtttactttcctttatgttgtagccacagaagtgatcttagtttagataggcttgtcaaatgattttgccaagagtgggcaaactttttctgaaaacggtcagatagtacgtattttccgctttgtgggccacatggtctctatcccaaatatgcaactcttccattgtaacatgcaagcaaccatagacaatatgtatagaaatttacatggctggtttttttttttttgccctttttatttatttatttatttttattatactttaagttctagggtacatgtgcacaacgtgcaggtttgttacatatgtatacatgtgccatgttagtgtgctgcacccatcaacccgtcatctaacattaggtatatctcccaatgctatccctccccccttccccccaccccacaacaggccccggtgtgtgatgttccccaccctgtgtccaagtgttctcattgttcgattcccacctatgagtgagaacatgcagtgtttggttttctgtccttgtgatagtttgctcagaatgatggtctccagcttcatccatgtccctacaaaggacatgaactcatcctttcttatggctgcgtagtattccacggtgtatatgtgccacattttcttaatccagtctatcattgatgaacatttgggttggttccaagtctttgctattgtgaatagtgccgcaataaacatatgtgtgcatgtgtctttatagcagcatgatttataatcctttgggtatatacccagtgatgggatggctgggtcaaatggtatctctagtcctaggtccttgaggaatcgccacactgtcttccacaatggttgaactagttgacagtcccaccaacagtgtaaaagtgttcctatttctccacatcctctccagcacctgttgtttcctgacttttgaatgatcgccattctaactggtgtgagatggtatctcattgtggttttgatttgcgtttctctgatagccagtgatgatgagcattttttcatgtgtcttttggctgcataaatgtcttcttttgagaagtgtctgttcatatccttcacccacttgttgatggggttgtttgtttttttcttgtaaacttgtttgagttcattgtagattctggatattagcccttcgtcagatgggtagattgtaaacattttctcccattctgtaggttgcctgttcactctgatggtagtttcttttgctgtgcagaagctctttagtttaataagatcccatttgtcaattttggcttttgttgccattgcttttggtgttgtagacatgaagtccttgcccatgcctatgtcctgaatggtaatgcctaggttttcttctagggtttttatggttttacgtcttacatttaagtctttaatccatcttgaactaatttttatataaggtgtaaggaagggatccagtttcaggtttctacatacgactagttacatggctgttttctataattcaccgacagctggtataaacaataaactctaagacaaaaataatgatgatattaaaataaaattagccacactaaagttcaaatatgttcctaatataatatttacatttcatgtaaatatctcttgggtttatcttttaaaccttagaattttttttaaagctctgtgtatgataatcaaaggttagattttatttattgtatctatcctcatggtctgaagtttctcaacatttacagaacagaatttcttagcacaaattctgcctggcaggctggtttaatttaatttctgtctaattgttctctgtaggactttcattctgttatttctacatatgtcaacattgggtctatgtggcacccatgtaatggtatttccacctatttgcatgctatgccatcctattttgttggtgaccatattggacaatacactttttgctttctaaatagtaatcaacaggaatatcaatggtaatatatatttttcccacggacttttctgtagaacctctccttggcttctgaaagcttataatgaaggcatactcatacaccatttttatttagccctcatcatgttaacaggctctcacacaaacccaataattactgtggttcactcttgtggagactggctaactaacatgctcagcccataagaaaaatattagggaaaggaacgcacactctccaggttcacactcacccagctgcccagacatgctaaagaagtattcatgtgtgagcccagtttggtgtgcagatgttggagaatggcttgtgaagacctccatgatagcattaagccttctgcagagtgaactagctcaagatgaattttttccaggttttcatcattaaaaaggtttcatttaccaagatgggtttcagcaatctcacagtgtgacattgattttatggtgtaatttaatctgtacttaatttcaaaggctggtattcagagataaagctagactttgcagtatattcctcttgtgaggcacaatgcaggttccttctgtcttccagaagaaatgatttatcatgtagcatgcgattgatcaagccatggggtttcctttcatcttttagcttgtctgtattcacagtttttaaggctcttttcttttactgctcatatttttattatttttggttttaaaccattatagccaaaaatgttgccaatgtgggctttttaaaaattctagtttatcactgttaatgtaaagagtgagtcaaaaaattcatgtgaaactggagtcctggtttgaacaataagcatgtgcagaaacatcactgtttttaaaagctcacttcccaataccatatgaaaataaacggatgtttttaaaagcagaatttgtgtaacaattgttaataaaaagctaaaagctgacacaaaactctttcatctaggaagtatgctgtctaatatcatggatgctaaaagacaaaaagaaagaaagaaagaaaagaaagaaagaaaaagaaagaaagaaagaaaggaaaggaaaggaaaggaaagaaagaaagaaagaaagaaagaaagaaagaaagaaagaaagaaagaaagaaagaaagaaagaaccaaaaccaaaatgaagctcaaatctcagaaacagaacctcttgccttagggtctgagcagggagaatacactcaaacacccaaggggagacaggcagggtgcagccctgagggtactgatgggacataagaaaaagaccaacaatcgtgccacaaaggccccatcggctctgcctctgtcttgggcagacagttggtcatctcaagctcaccaggagcaaaatttttgtcacaactggagagggtgtgctaccatcatttagtgggtagaggatatgtaggggactactacagatcctgcaacctacaatgcacaggataatcgccaagcctggcctggagggtggggctgggggtggtggtctatggtgaactggagagcacaagcctccctataggagcaacatatccaaggatccggctgatgtggtcatgtgggaatgttccatgcagacacagaaccaaaccaaacaaggacttgagatttcttcagaatacaatgggatgacttcaaattatatttagaggcagatgagaagaatcaaaatttcttaaaatattttgccaaaaacacaataagaagaaagctgacttatttcaacccaaatcagattaaagaactgggtagggctggacatggtggctttaacctgtaatcccagcattttgggaggcagaagttggaggatcatttgaggccaggaacttgagaccagcctgggcaacaaggtgaaacctcgtctccataaaaagtataaaacttagccgggtgtggtagcatgtgcctgagtcaggaggctgaggcgggaggactgcttgagcccagcaggtcaaggctacagtgagccatgatcatgccactgcactccagcctgggtgacagagcaagaccctgcctcaaaaaaaaaaaaaaaagaaaaatagttgggtaaataattggatttggactcacatgttgacacagtgacgctaaaacgaagatgtcttctggggctcagggcacacaacctgggtgagagcagcctctatgtcccacattttaggctaagcatctaacccataaggctccatgttagcatcctcagtcagcctgtaatggaaattcaatgcaggcaataaatgaatttcatagggctaactcttttgttttaaatttagaaagacatttagtaatcatagggacaaactgggtatgtgattgaaaacatttttaatgtttaagagattttggctcattagaaaatgggcatattcattcagtcaataaatatttgtcaaatgattaaatgtattagccttttgatttctttctttctttctttctttcttttttgagatggagtcttgctccaccaggctggagtgcagtggtgtggtcttggctcactgcaagctccgcctcccaggttcatgccattctcctgcctcacctctcaagtagctgggactaaaggtgcccgccaccacgcccagctaattttttgtatttttagtagagacggggtttcactatgttagccaggacggtctcaatctcgtgacctcgtgatccacccgcctcggcctcccaaagtgctgggattacaggcatgagccactgcgcctggccttgatttcaattttaaatgtgaaattgattttaggcttgtgattgtaagttgaaaaatataacaggattttactgtttggtaaataatactggactctttaagtgacctttcaattctctcaataagtatgaatatttaaaacatttaataagctagaagacttaaaagtttaaatggcaaaatctaaatatttaagagttttaatggtaataaattgaaatatttaatgtttaaatagtaatgaaattaagtatacatatttattgaataaatcaatgtatttattagatttataaaagttgtttacgtttctagaaagaatttgcttgtgtgggttgtacgtttgcccagctagacagatacttgaatggttaaacagaaaactgaatatattgactttataaatgtacactaacatgtataaagaatttttgctaattaagtttataaatgagagcaattgtttgaatttaaattgttcagttcaaatttaactctaatcaaaaccctctgtgaaacgagttgtttttattatatataaaagatactggtattattaatataagcagaaaaatgaaacttttttttaagttgaacttaaaagcttgaggaaaatcttgattttataatcataataaattaatgtagatttaaaggctatataactgtaaatagccctttctaaataaaaaaaaagaacaagaaaataagaatgccagtcttagacatttaaaaaattatgaataacagctaaatttgtcttttggcaatcaagaaataatgttctcattaaacaaaggtgatgtgtcagaagggcgtgtcactttcaatgtgcagtaggatgctgaggatatagaatcagtccctatcttatcatcttgtgtcactggttccaaagtcacatgatttctggagccaactctgcatgcctcatttacctctaggacaaaggactttatggctctgggcagataaaacaatgggggctcagttaccattcaacagaatacaagaatattagttctgaaaggaccctcactctcctcctcacttttagagaaagaacactttccccagtggtgaaatggccaggactggtccttgggggcagtgttaactctccatccagggcataaactttggaggacatttccggcagggttatttatatattcttccccttctgttagtttcttagggtatattccaccatatttgccagtttttatataacaacggctccaaacctccatgaattccttttctgtttgagcaaatgagtaatggggtgccacaaaacaaagtatatggagacaacaaacttctgagaactgtccaacagtgatgtgtgaatgggtgtgcacacatgtaggaggggacatgaaagtgtggaatctactttttttgtctaattttctatcgtttacaaaaacttgaaaatgataccaagactatgctacacaatatcatgacatgcaattgttaaaagaggcatattactttacttttttctttcctgctctgcctatttagaaaatgtatccaaataacccatgatggcactttataacagccagaattgatagtcagatagctcttaggctagtaagctgaaaataagagctaaaccctctttatcctaccgccttaaaacaaaacaaaaaacaaaacaaaaaaaccccaaacaaaaaaaaaagcccagtaggctctctatgtggcagtaaaccatatagtgccatctactggctgtttactaatacgtgttattcaatcagggccaccaaacaaaggcattagatgggagacatgggagaagcaagctctgtcctcactctttcctctgtgccttgagactgttgtatgccctcggaaacacagagatggcaaagctccttctatgagaaagcatttcccatttccactgggacccatttttttctttcttttcttcaaagaagcacacaagaactgaaaaataccttcaatttggcttggccatcaacaaacacatttctaagcaaacaaagattacgtttaactccctcattttcttttcccactcctgttcttttcaataaaaagattaactaaagctggccaacaaatcaaggcaaatatctggagactttgaatcctgcaccgaggcttcataccgcctggacagaaggaggcaaggataattgagtgacgactactctagcatgaagtatgctgtttgtttctacttgttggtttcatgtttcaattcattgtggcatcagggcaaacggatttttgtgtaagctcttagctgagatgatactgctgagcttttgactgtcctgccatttccctccatgaattggcaggaaaaatatttatattttaatcaaatacaaatacacatgaaacagtctttttaggagtttcttttcctgtgtaatgaagtgaaatgaggggaaacgctgaactgactaatcagattcgccactccaaagaagctcaaatgtcatctctatggcaacatgtcagccagggtccgccctcatctcttccctcagactgcaaactgcacgttgccactgctacatgaattaatgtggagaacacactaaaaacagtgagatttggcttatgaagaaggatcttaaggttgatcccattcatgtaacactctatcctgtttttaattttctttcttcaaattgaattagtctttgaggacctgcttcacacaatggcttcactcactggctcctcactctgtgtttcagagggatgccaagttgttgagtcctttgttctgggaggggactgaggtcatttgcactttggaccccaaattgggcaaatctcagagaggtgatgcaatgcagaaggtgagtccagtgtatataccagggaactaattttaccatcttaagaaggcatgcaaaagtttatctattcattggaagatcacctattgaaaaatatgttatagttttctgactaaactcatcacaggctagtgtttacgtaggtagtccattagttttaagacccaggagaaatgtccctttcatcaatcatgtgcctcatattcgtgttccttatgagggaaattaatctgcacagctcctctaaattcttcattttattataattagctatttatttttatctgttcttaaaattgtggaaagtggctcagaactatcttccttaagattctttttatacttggctgggtgcggtggctcacgcctgtaaatcccagcactttgggaggctgaggcgggtggatcacgaggtcaggaggtcgagaccatcctggctaacacggtgaaaccctgtctctactaaaaatacaaaaaaattagccgggcgtggtggcgggcgcctgtaatcccagctactcgggaggctgaggcaggagaatggcgtgaacccgggaggcggagcttgcagtgagccgagatcgagccactgcactccagctgggtgagagagagactctgtctcaagaaaaaaaaaaaaaaaagattctttttatacttgaaagccttagagtaggatttctacctagctttcaggcaaggaagccaattggacaaaagcaaatgttgcaagaagccaaattcactgagtctacctattgtaggtttaattgttttaagtggaatgttgtattttagtgactaatatatagtttctcaaaataaggtaaattaagagtaggcagaagaatcctaaaaatgctaaaagtctggcaaaagagaagtataaacttctcatatggaaaactatttttgcatcccctcaaattggtatttatatgtaacaggattttttcaatttcttctgttgctgtctggatggttttaaacgacgctttctattttttcacatttatctatgttttttttttttgatggagtttcattcttgtcgcccaggctggagtgcagtggtgcaatctcagcttactgcaacctccacctcccaggttcaagcaattctcctgcctcagcctctctagtagctgagattacaggcgcctgacaccatgcctggctaattttttttttttttttttttttgtatttttagtagagatcgggtttcagcatgttggccaggctggtcttgaactcctgacctcaggtgatccgcctgcctgggcctcccaaagtgctgggattacaggcatgagccaccgcgcccggccacatttatctatttttaattgattattagtcatttcctagtatattaagcaatccaaaaattttaaaacttaaatgtttaaatggaataaaaattgctggtgggaatgtataatacaaccactatggagattccttaaagaactaaaagtagaactaccatttgatccagcaatcccactgctgggtatctacccagaggaaaagaagtcattatacgaaaaagatgcttgcacacgcatgtttatagcagcacaattcgcaattgcaaaaatgtggaaccaacccaaatggccatcaatcaagtagtggataaataaagtgtggggtgtgtgtgtatatgtgtgtgtgtatatatatgtatatatgtgtgtgtgtatatatatctatttcatcatatatatgatggaatactactcagccataaaaaggagtgaattaatggcatttgcagcaacctcgatgatattgaagaccattattgtaagtgaagtaactcaggaatggaaaaccaaacattgtatgctctcactcataaatgggagctaagctatgaggatcaaaaagcataagaatgacacaatggactttggggactcagggggaaagggtgggaagggggtgagggataaaagactacaaattgggtgcagggtatactgcttgggtgatgggtgcactgaaacctcacaaaccaccacttgagaacttactcatgtaactaaataccacctgttccctgaataacccatggaaataaaaaatttttaaaaaatgaaaaaaaattaaatagaaattaaattaaactaaattaaacttaaataagtacaagtaaaattttaaatacaaattcaaaaatagatcaaataaataagaatttaaataacaattgagttaaaatttatattaaatatttaaatttaaattcaaaagcaaaaagcaacaaattgctaaaacaattccatcatatgatttgattatatatctgtacatatatgtataaataaaaaatatatatgtataatacatatgtaggtgagatatgttgaatgatttgacatgagaggtaaaatcatataaagtagtgaaaagggagtttggaaggccagaagggacatatgaagggttaaatgagtggtagctcatctttaaaatatattaactataagtatgaaattggacttgaaggattaaaaaaataaattggttaaaacttctaaaaatgctgaaagataactgtaaatgaaagtacattaaaatattttaaaaatttagtttaaactgaaaagtaattctgatatgattattgataatgaaatatgtagttctaaatgtatttaatgtgctttattaattattaaatagattgtataggaaatgcacatgtaacctattatcagatactaaggtggaatagttctgttaaagctgtttaaatagtccttggaacactctaaatgccatttaaaaaataaatcagaaaatttatgtattgcctttgatgaattaacagagccattatgtgtgtgtgcatgtgtgagtttgtgtgtttcaaatctggctatttcttacctctcttcccttaaccattgcgttctgaccaatgaagagaagagcagatttagtattttccattttagtgctataattctgttaatgcagcgcctgtttggttcccaagtgacatgtgtcttatcttagctttcgttccactgatactgccacatatttttcactagaactgatgttaatcaaactttctctgattctgctgttgtgcagctgatctttttttgaacctaagtactagatttttcccctggttacattttatcttgttttgtaaattatgttgtattgtttgttatgtattagttaagtctgctctgctttactggaaacctcttgtcaaatcaaggatgcggcttctaccttagtccactgcaaaaataagtaaaaaagaagagtcaagttgatataggccataagcaggtccagctcacatacaggccaagagtagaggtttaagtttgttggtcggaacagggaacacatgttgcatgaaatgcaaataataaagaagatacagaactccaagagtgattattaatgtacactctggaacctccatatctaaatgagcattcgtctttgggaagatccatcttggaagcttaaatgtaagttctaattaagctaaacttgctcaagagtttcagagtcactcttaaaagttccttcagaaggaggaacagaagtaacaagaaagaagaggtcttagaggtgccaatttgaggagatcttaagtttcccaaagaggctattgaagttccaaattaccctcagcaaaattgtaccaacaagaaggaggtggacagagttggtggagcatatagtgagcaggggttcaagaaagggggctcagtcaattgagaagctcctatgggagatgaaggatcagataaagaaaacagagagacctcacaaagtgccagaaaaaaattttcagcccaggtagtcaggaagtaaattcctactcaaaagaaacagccatgaaaaatcttccagtcctgcaggtacctttctaacaaagaagcccagacctctaacccagcttctgcttgtctgggactctaacctaacttcttacagagaaacctaggaccctaaccctatgcttgacagataactcatatctaataagtattgattatgctaaccaaactgatatggcacttgtattcccatgccactacacagaggtgctgcagtatatcctaatatatattttataaatcattattttaaaaagttccttcacagccagcttacaagtaacaataaaattagcctttgctgtgagaaaataaaaagcaaaattgtgaaaaacagcaaaataaaatatatcaggaatactttctaaaattaatgtaccttgaattctggtactccaggaaaagcagctttcatcagaagaaaatatggaggtagtcaaagtctttcgtcaaattctgaagggggcttctaagcactttcaagagttttcaagattggcgttcttggctttttattatatctaagtccacttcaaatctcaatagcatttattttctttgataaagtgattctaactcctcttctgtttgatgtggataatcttaaagtttttctccagttctagaatgctttgttttgtaataagaagcaaattatataatcagtgggttttttggagatcctgaatggcattgggcagtaaagcaggggatgaatatgggagtgaggagaatgaaaaagagggaggagggataaaggaggggcgagggaggagggggaggggagatggagggggagagggagcaagaatgtgcacaaataaaggttttttattaaaggtcaccagaagggagttggaaatgaaaaagaatgaagaagagaatgtgattggaaaggatgcatatgagaagcaaatgtctatagttaactgggctgcaagaagagttaattgggtgggaagggaaaggcaaggtggattggaaagaaggaggaagatgggccaagaaacctcacattagacactgctccacattagacaccaaagaccaaacaaatcagatgagttttagctgcttcttggcattggagagaggaggggaaaggaaacagtgggtatccatgtatttttatgtactggtcaaatccaatgttcattaattgagtcatgaatgcattatttgttttcagatatcacattgagaaacctcataatggaagcatagcattaagcattataaaatagaataacacagacattaatgaagcccctgcatcagacagaggtattgtaagattctttccacctgtcaagggattgtaataaatgggaccctacaagctagccttggccttcctgaagatcagcaatcttatggattctttgttgtgggtaatgagacccaagaatgtcagcatatatattaagattgattgaaaaccaggtgacctcagggacaaaggcatttcttttgctaatttaatcagtaatagtttcaaaggcttttaaacctcaggttcctacacaaacagctcctgccaggtagataacagagggagcctgttctcttttgaatacttagccatgaattacaagcatcagttggacagaagagattgaattcctataggtactatccagatcataaaaaggtattaaggcttgccctctattcctgctccatcagcatgaagagaggtttctaagagtcttaactcacaaaaaaagcaattcaccattttgttcaaagcaaaatcataaccataaattgctcttacgtagcagtttgtgcctttttgtctgtttgatcttgataataccactattctgtttgatcttgataatatgccaaggtaggggcaggcaagtttctaaaataaagtcatgaaattttaaaacattaagtggttaatctaaggtcattctgagcaagttagttacagaatccagacagagtgtagaaggcttgatgcctattccagtattcaggacagtcagaatatccaatgtcaggcttctcatcagaattcaatttttatttcattttatttgaattaagttcttgcaacggtgatgaaaaaaggcatccaattcaaccacacacaattattgctcacctaaagtgttctaaatgctactttggggttacattacaataaactagacacagtccttaactttaagtttattgtccagaatgagagataagaaaacagaaaaagaggtcaggtgtggtggctcatgtctgtaatcctggcactttgggaggctcaggtgggaagatcactcgagtccatgagttcaagaccagcctgggcaacatggtgagacccctgtgtctacaaaaaatttaaaaactagctgggcatggtggtgcactcctgtagtcccaggctgggcgacaatgcatgacccagtttctaaaaaagttttaaaaataaaaaaaagaaaacaggaaaataaacagttaaatgagttaagttttccaggtggagaatgtggcaactggtataccagcttatttgcttacttccaatgatttactctctttctatatatattaagcagctactatctgccatgtactgtactcctctgtgctgggaatgcatagatggaaaggtacgtgattccttctctctaaaatctctgggaaataaatacatatggaaatagccaaaggctttgcaacgaggttatttctagggcaaagaaatgtacacacaaggagcaacaggatcacagagaaaggagctgtcaagtctacctggggagtgaggcaaggtttcactgaggaaaaatctgcctggagaagttacgtacttattttatttgtttgtttatttatttattttttttgagacgagtctctctgtcgcccaggctggagtgcagtggcactattgtggctcactgcaagtccgcctcccaggttcacgccattctcctgcctcagcctcctgagtagctgggactacaggcgcccgccaccatgcccggctaatttttttgtatttttagtagagacgggtttcaccgtgttagccaggatggtctcgatctcctgacctcgtgattcgcccgcctcggcctcccaaagtgctgggattacaggcttgagccaccacaccaggcctttttttctttatattcttattatataagctcttttcttttcttttcttttctttttttttttaacggagtttcactcttgttgcccaggccggagtgcggtggcgcgatcttggctcattgcaacctccacctcccaggttcaagtgattctcctgcctcagcctcctgagtagctgggattacaggcatgtgccaccacgcctggctaatttttgtatttttagtagagacggggtttcaccatgttggtcaggctggtgttgaactcctgacctcgtgatctacccgcctcagcttcccaaatctattctttttaactttttaaactttttttgcttaaaaatgaagacaaacatgcacattagcctaggcctacacagggttaggaacgtcaatatcaccgtcttacacctttacatcttgttctgctggaaggtcttcagaggcaataacatgcgtggtgctgtcatctcctatgataatgccttcttccgaaatacctcctgaaggacctgcctaaggctgttttacagttaacttttttttctttaataagtagaaggtgtatactttaaaataaaaagcatagtataataaatacataaactggtaacataatttcttatcattatgaagtattatgtactgtacataattgtatgtgctagacttctatacgactggcagtacagcaggtttgtttaacccagcatcaccccagacacgtgaggaatgtgttgagctatgacattatggcagccatgaggtcagtaggtgataggaatttttcagctccattataatcttatgggaccaccatcgtatatgtggtccattgttgaccaaaaagtcattatatggtgcatgaccgtatatatgagatatatatatattaataaatatctgtttgtttatctcttgttaatgtgtctcttgtaacagggtcccagcctggaattgaaaagagtagaaggaaaagggatttctttctcttccctacattaccttacatggcaaaaaggtctttgcagatgtaattaagttaaggctcttgagatagaaagatgatcctggattattcaggcgggcccaatgtcatcacaaaggtattttaagggtgaggcaggaaggtcggggtagagaaagagatatgatgacagaagcagtagttagagagatttaaagacaccttagtgttggtcttgaaaatggaggaaggcaccaagaaccaaggaatacaggtgaccactagaagctggaaaaggccaggaaacagattctcccctagagcatccagaaggaaggcagtaatgccaagctattttggatctcttgttatgttttaagccactaaatttgtattaatctgtaacagtgtcaataggaaactaatacaagagcaaacagagaaataaagaattaagttttacatgttgagtttgagtgcctgtggtgtacccacttggaattcaaaccaaacgagagtaaaacatattgaattcagagtgtgcagcacataggtcatggcagatgccaaggggatggaaggggttatcaccttccatctagttctagcaagaactagaaagcagctggggtcacaccctggaaaacagcaactttaaataatttcacaaaggaaaatggtaagcaaaagaaatgagaaagagcagtccaagaagtggaaggaatttttaattttttttagacaaggtctcactctgtcacccaggctagagtagtgtgatcatggctgtctgcagcctcaacctcccaggcttggtggattctctcacctcagcttcccgagtagctgggactacaggcatgcactaccacacctggataactttttgtagagacgaggtctccccgtgttgtccaggttggttttgaactcctgggctcaagtaattctcctgccttggcctcccaaagtgctgggattacaggcatgaaccaccacgcctggcgaggtaggaaactttgagaaggccatataataaaaacctgggtgaggtagatagaaaggaattgtcagaaaagttaagtctatttcgaggtcagttgggaaaagctcagagaagaggacattggattggacaatatggcaggttttcaataatgtgggcaaaagtagctccagtaaagctgtgggatgaaagccagataaggtagaagagtgaatggaaggtaggggaagtggagacaatgatagtccataatttctagaatgcaaccagatttctcttgaaagctgggtgagcaacagggctaaagctggaaggattgaggaagaggtatatgagtacttgcttgtttgcttattttggaagttggaggttattggagcatgttgcaggctgaggggtaaagatagtaaaatgtgaggatcaagactgggctctcgggaagcctcaattttaagagcaacaatttctagagagtcctatttttcttttctttgttttttttttgagatggagtcttgctctgttgcccaggctggagggcagtggtgtgatcttggctcactgcatcctccgcctcccaggttcccaggttcaagcgattctcctgcctcagcctcctgagtagctgagactacaggtgcaggccaccacgcccagctaacttttgtatttttagtagatacggggtttcaccatgttggccaggctggtctcgatctcctgacctcaggtgatctgcttgtgtcagcctcccaaagtgccaggattataggcatgagacaccatgccaggccagagagcccttctttattcatgtactcataacatgagcccagctcctaatagtctttcaagtgtccattagctgagaaaattagatatcctctccatcctgtggctttcagaatttatctcattaatttctatccatcaccagggctctgatggtgggaggggtgtggaggtgtggagaattgaaagtagggattgtatttgtatacactgcaggcagcatcagaaagaagtaaaaagcttgatctaggcacttagtcctaaatagagagataaatcttttaaattgttttgggagttaagctaaactaattgttgaaacattaatttcagccaggagtatatttttaaatagagttgggaagaagagaagcaatgactccaaccagactcaaagaaacacagatgaaagaagtgacaatgcatttctgagttcctttacaccagattgtgtgtttacagctgcggtccccaaacttcttggcaccagggaccagttttgtggaagacaatttttccatagatgtggtggtagggggatggtttcaagatgaaactgttccacctcagatcatcaggcattagttagattctcataaggagtgcgcaccctagatctctcttgtgcgcagttcacaatagggttcacacttctatgagaatccaatgctgcagctgatctgacaggaggcagggctcaggcggtaatgcttgctggcctgccactcacatcctgctgtgtggcccagttcctaacaggccatggaccagtaccggaggttggggacccctggtttacagtttaagctgagaattaagaattgaagtggcttaaataagtgaaggggaaaaagagaatcaagcttttgcctgagttaatcaaaatgacgttctaaaatatcaaatctcctttagtttgtgaatatgtgggttttcagtgatggaaatgaacaatgaatgcactttccacttttaaaaaagtgtaaggagtaagagttatatatgaaataaaatctcctttcctagcttcatgggaatttgcctcaaacacctagggaagtgatatccccagagtataccttgtgatgtgcaggctccttgaaaataatattcttaagatggtgacctcaaagaaagagggctcacattgctgtttgtaggtttaaatttgataaatgtgttatggatattgaacacgaaagaaaaacagcaaattcattttagtgacctgagaatatttctcagagtctttctagtgcatcatatgacattaattcattgttgctgaagtccccaaatattctataactcttgtcaagttcaaaggtaatttcaaacccacatttgcttttgtgggtttaaaatagcagctttctaatgacttccatcactacacctctacatgtaaagaagtggtatttaggatgatcttttggatcactggtaatacattccaatatgtttgattagtgttattagttgttcttggagatatgattttccatatgtaaagcaatagtacattttcaaaatatcaaaagattaagttgttctataaagctctaaaggtgttttaagaactctggaccacttctatatctgcaagtagtacagtacttttcctaatacagtacattggattgctcgaaaatcatttatctttgccattttaaatgcccatctcacatgcaaataatctgtgtatgagtcactcacccatcaggatgcttttttgtgtgtggaacaatgacttataaagtacacctctgaaacacgagtccacacagatgaatgaagcataaattcggcctcagggataacaaaagaatttgcatctgcatctcagcgtaaagtgattcaggtgcttcttgaatttcatattttggttaatgacattgccaccctgtcaattgctcaggatcgaaaccaccaagtcatcatgaaatctcttttcttcctcacaccccacatccaattagctgcccaatcctgttaattctatgacctcaatgtgtttggcatctgacccttcctgtctgccgcccttagttcctcctgcctggattttgtcatggccttggaattggtctccctggcttgggcagcatcctttcttcgttacttctctccattgccaccttgtttctcttcctatgatttagattacatcattttcttcctcaaaagatgcgaggaattgctattaccaacagcatgaagtgcaggatcctcaggccgatattcagattacaacagtgtagcccatgggccagtgtggtcagtgaaccccttggtatggttcatgatggagatacatagagaaatagggagtagtcattaagaaactttcctaggcattcttttattttttcccacatttgttctgattatattattgagatgtaattatgcagctgttgaatctagtaatatagttttaaaattttgtagcttttaaaataattttttatactttttctagtaatttacttttactgctgaaaaatatatgtatcagtatatgatcaatcaaaaatttaaaacagtaatcatttgggaagcactgttcaaactgtggccctgcccggcagcatcaacatcacttgggagcttgttagacaagcagaattgcaagtcctaccccagaactacatacacagaatttctgggggtaggtgccagcacttggtgttttaacaagctctccaggtgcatgctaaagtttgagatacactgatcaacaatctttccaccacttcttggacactccctagcccctgatggctattaagcacttgaaatgttgctagcgtgactgagaaactgaatttttagctgtatttaatttaattcaaatctgaatagccatattggacagctagtggctggccatactggacagtacagtaatgggagttctgttcccattactacattcttaaatagacagccacagtgtcatcttggtgccgtatttcaagattttcagtttatctaggaatatttgttctccaacccccgcactttcataccagtctattaaatttatccattttttaatgtaaatctctattttcacctcttccaagaagacctgcaggaccatccttatttaaatttacttccctccttgttttcctcatcacctttttttctaattctcttatagaacttattatgctcttctttgtacctaagttacttggggatgagtttgcctcccccagatggagagctgttggcttaattgtccttctatcacgcaacagcatctagctggtactttgcaaatgcgagacacccaacaaccatgtaattgaattaaatgtacaggaaaccagaaagaaaagtcctcaacaccaacaatacatcctagtgttcttagaagttgagacagatcagaatgttaacatacacaatttagtttagaataggaaaaatgttaaagctatggtgaaacatttgtcacaggatcaaaatacattgttataaaaataaacacagtgcctgcttcatcatttctttagcagcaggaaagcattttcctttggcaatcctctacctccatcaaaattgttccttaactaaatgtgagattaaaaacagacttgtagctcttttttttaaaaaaaaaaatggcactcctattggcagaaagatattcttgctgatataaaagcagctttcccatcaactggatgaaaaatttttgacttcaaaatagatcaatattttgctacaaataaaaaatatttattttttataaaaagaataaaatacaattcattctgctttatttcagagttctctactttatcccgtttttacatagctataaaattaaaatacatgaaagtaaccacaccaaaccaaacattaaggtggttaataattaagtatattctgccatcagtgtaataaacctcattagatttttatagggattacatacccacactgactcacaaatacagaactccaaagaacttacacttcacaatgccttcacacaaaagtgaatgggaaacgtatgttactttccaacaatgggcaatggcagcattcatatgagatttgaaaacctgaatgtcaaatacaattgacggttttctatgtgcctttcattatgggaactcaccaactaacatcaatgccaactcctcttacaagttgtattttcttttttttttttttttttttgagacagagtctcactctgtcagtcagactggagtgcagtgggacaatctcggctcactgcaacctccgcctcctgggctcaagcaattctcctgcctcagcctcccgagtacctgggattacaggcgcatgccaccacgcccggctaatttttgtatttttagtagagacggggtttcaccatattgaccaggctggtcttgaactcctgacctctggtaatccgcctgcctcggcctcccaaattgctgggattacaggtgtaagccaccgcacctggcctacgagttgtattttcaaaatttttagattgtctgatagtgccattgtgaaaaacacaagtgtattgatgggacgcatctcaaaataataggagctatctatgacaaacccacagccaatatcatactgaatgagcaaaaactggaagcattccctttgaaaactggcacaagacagggatgccctctctcaccactcctattcaacatagtgttggaagttctggccagggcagtcaggcagaagagggtattcaattaggaaaagaggaagtcaaattgtccctgtttgcagatgacatgattgtatatctagaaaaccccatcgtctcagcccaaaatctccttaagctattaggcaacttcagcaaagtctcaggatacaaaatcaatgtgcaaaacccacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcatgaaaatggtcatactgcccaaggtaatttatagattcaatgccatccccatcaagctaccaatgactttcttcaaagaattggaaaaaattactttaaagttcatatggaaccaaaaaagagcccgcatcaccaagtcaatcctaagccaaaagaacaaagctggaggcatcacgctacctgacttcaaactatactacaaggctacagcaaccaaaacagcatggtactggtaccaaaacagagatatagaccaatggaacagaacagagccctcagaaataatgccgcatatctacaaccatctgatctttgacaaacctgacaaaaacaagaaatggggaaaggattccctatttaataaatggtgctgggaaaactggctagccatatgtagaaagctgaaactggatcccttccttacgccttatacaaaaattaattcaagatggattaaagatttaaatgttagacctaaaaccataaaaaccctagaagaaaacctaggtattaccattcaggacataggcatgggcaaggacttcatgtctaaaacaccaaaagcaatggcaacaaaagccaaaattgacaaatggcatctaattaaactcaagagcttctgcacagcaaaagaaactaccatcagagtgaacaggcaacctacagaatgggagaaaatttttgcaatctactcacctgacaaagggctaatatccagaatctacaatgaactcaaacaaatttacaagaaaaaaacaaacaaccccatcaaaaagtgggtgaaggatatgaacagacacttctcaaaagaagacatttattcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtaggactgtaaactagttcaaccattgtggaagtcagtgtggcgattcctcagggatctacaactagaaataccatttgacccagccatcccattactgggtatatacccaaaggattataaatcatgctggtataaagacacatgcacatgtatgtttattgtggcactattcacaatagcaaagacttggaaccaacccaaatgtgcaacaatgatagactggatgaaaaaaatgtggcccatatacaccatggaatactatgcagccataaaaaggatgagttcatgtcatttgtagggacatggatgaagctggaaaccatcattctgagcaaactatcacaaggacaaaaaaccaaacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtggcacatgtatacatatgtaactaacctgcacgttgtgcacatgtaccctaaaacttaaagtaaaaaaaaaaaaatagaaaaatacaagtgtaattcaacaagctcccagagtccacacaacacatatgatgttctcaaactgttctaagacagtaggaaaagatacaggtttattgtggacagttaacttagacaaggaataggctggtaagtctaaaaaagggacactatatttatctcaataacctaccatttattagaaaatgatggcaaaattttttaagactgaaaaaagataccacagtagaaaatacataatcctagctatgttaaaaacaaatgtatgttaaagcatataaaattaactgaaacaccaaactgttaaaactggtttcccttgagtgcgtagtaatagtgggggtaatgagggatctattttttttaaatgaatctactttatatatttttttaaatttgaatattgtataataagaatgtttccacgtactacttgcataaccaaaagaattattttaagaaaattaaaaccactctcttttcttttgttttttctttttttcttttcttttctctttcccctcccctcccctcccctcccctcccctcccctcccctcccctcccctcctctcttctcttctcttcttttccttcttttctttttaaaatagagacaagatctcactatattgcccaggctggtctcccgggctcaaacaatcctctcggctaagcctcccaaagtgctgggattacaggtctgagccactgcacccggcccaaaaaccacttctatctaaagaaaggcaaaaaaccacttttcttcctaacaggaatttccccccctaaaatgtagtataaatgcaagttaaacaacttaaaaaaataaacaactttttaaggaagacataaaaatcaaacaggactccctaatgacctctgattgactcttattaatgataataaatgttgatataatgctttacagtttagaatttgccctttacattcattatcacagttcttaatttaatggtgaaataggtatcaccatcatcattttacagatgaggaaactgaaattcaggcatgttataccttttggctgatatcacccaggttgccagaatttgatccaaattttggttcaaaagctcagatgtcagctgtcacatttcctcagttgaaggagatacagatcagagaaactgattagcagaatctgactagagaagttaatccagacaattagtgactttgtaaagtgtaatggatttatttaaattatgtataaaatagtaatattttatgcagcttggaaagtctctaataacttccttccatactctttctagtgatcttatccttaattagagtaatcaccagtgagagaatgacttaagtttccttgaatcctaatcccatgttcatggttgtgtcacctttaagatctattcattgttcattcacttttcctgcaaatatgtattgatctcctaatatgttgcttattgtgttcatagcaaatgcagtcagggagaagaatgaagcaccatctctgttttcagggaattccaaatccctgggaaaataggtgcaaaataataaacccacgtggcaaaaagaaaatcaacaccattgtatgtgccaaactgcagtggttcccaactggggtgggggtggggtactgtgccacccagggattttcagcaatacctggagacattttggttgtcatagtttgggggtggatgttactggcatgtaatgggtagaggctaggaatgctgctaaacacctagagggcaaaggacagcccacaacagagaattatcaggccccaaatgccagtagtgccaaggtttagaaatcgtttgctaaggatatcatcctttccagattttaaataaagaagttcagtcggatgtggcggcttacgcctgtaatcccagtattttgggaggccgaggcgggaggatcacttgagtccaggagtttgagaccaacctgggcaacatggtgaaaccttgtctctaccaaaacaaaaacaaaaacaaaaacaaaaaccaaaaaacaaaaacaaagcaaacacaaaacaaataaacaaaaaaaatcagccaggtgtggtggtgcgtgcctgtggttccagctattcgggaggctgaggtgggaggattgcctcagccttagagatcagagctgcagtgagccgtaattgcgctactgcaccccagcccgggtgacagaccaagaccctgtataaataaataaataaataaataaagtctatgctggctaaactacagaggaatttacaattatatgacaatgaatagattaaaaatgtaagtaatctactcttgaataaatgctcttatcttattttacatctgtcagtgaaattaagacaaagtgcaatcatgcaccacataacaatgttttgatcagtgagggactgcatatatgacatgttcccataagattacaatagagctgccctttacaggtgtaccatttttaatcttatataccatattcgtactgtatctgttctatgtttagatacacaaataccattgtgttacagttgcctgcagtattcagtacagtcacatgctgtgcaggtttgtatcctaggagcaataggctctaccatacagcctaggtgtgtagcaggctgcaccatctaggtttgtgtaagttcactctatgttcgcacaatcatagaattgcctaatgatgcatttctcagaacgcagtctcgtcgttaagtgacacatgactgtgcaatctttctggaagtggcctaataatacctaagtaggtagggtgggggattccacattataggggaacgagttcatcattcttctgccccacccttgactgagccctcactgtttctctccagactgctgcacaccaggatcagattgcctcctgttcagccctctttaacagatccccactgctctggggataacaatcaaacttgcttcaacaactacatggcatcgatgacctggaccctgcctacctcatcctctcaccttgttcaccttgccttagccacagtgatccccaaatcattttccctgcacagagattccacacagtctgttccctctaactggaaatatcctccccctaccactaaactcttatgtttcgtatcatgacctaaatatcacaccctaaaaaggcttttcttaacttcccatttcctttcctgctctgctttctttttttttcttttcttttgagatggggtctcactctgtcacccaggcagtagtgcagcagctcaatcatatctcaacctcccagacttagcctcccaagtagctgggactatgggtcccaccacgcccaggtaattttttttatttttaattttttgtagagatggggtctcactatgttgcccaggccgtgctctgcttccttatccattttccacccctctctcccctgctgtgtgccccatccccatgtgtcagtgtgactccagcacccttgctgcttggctctaggttgggtttggccattaggcagcattggtaaaaaatctgaaggctgcaggtaatggacatccaggtattttcatccgctttcctacttgggtgccattctgggagtgagttcctcccactagtaccaggactccagctctcagtaagccctggtgccacattctgttcccttattcctacagctgatgcaagtctctgggcaagtcagcatctctcctgtgttcccttaacactgacccacctctgaaagtagccccttcatcaacaaattttcatttgaaccatctaaactgaattttcttttccagtcaacaccctaacattcacattcctcaattttaaatcagtttttcttcatatagattcttccacaacaccaaatcattttccctctgagctcttatcatattttataaatgtatatatacgtgtgtttgtattttgattctttgtgtagtatctgtcacctgacctggcacaattttgtgtattttacagggaacatagttgttttgctaatgacagttgaatggacggatgaaagggtaggcaatatccttgctgaagatagacatctggatctttcataaattattgcttaaaagcaatgttaatataaggaagttatgggtgaatacaacagcatatatgaaggaaaattcttgaagttttaagtgcacgcatgcaggcattcaactgacatttgttcagcaccttgtgagtaccacactcttcattaggcattgggagcacagatgggaaaagaaaacagtctctttcctcaaaggctcaaagactggtggggaagatgagaatgtaaagagaatggggcacatgggaaacatgagccagggctacaaggaggtcaatacagaggttgctatcaaagggggaaggtttacaagggaggcatctggaaatagaaaaaattaaacaagaccatgtttcaagtttgtttagaaaacacgatggctaatatgaccataaagtctttgttgcccctcaaatttgaagaggaaaggaagaaagaagcatccaagccaaataggttgctttgaggtaacgtctcagcccagataaaagggggcagttggcactggcagaaaagcagaagagacaataacaaaaattgactggtgtttactacaagactccagacatgtgggtcctgatcataacgggagtccaaacgggacaatcaccgaagcctgtagctggagctcctggaacccagaaatttctgagtttaggaaggtttaagtaatttacccaccatcaagtttgatacacatgcatgtgtcattgggtggtatgcatgtgtgtgtgtgtgcatgtgtgtgtgtgcttacaatatgatatttgcaatacttcaggtaacagttacatttaccaatagtcttggaatattaaaaatattctaactttttttcattgaaataatatttttaccctctcatatagaggaaaagtgctattttaacaaatgctttcatcatcttcatggttctgtctgtgagcggccccagcccagagaagccaggatgagacacaaatcattctgattaaaaccaaataaacactgaggtcctatcctcagtcagacattagaccagggatcagcaaacttgttataaatattttaagctttgtgagccgtatgatctctgttgcaataagtcaacattattgttttaatgtaaaaccagacatagacaatatgtaaatgaatggggatggccatgttccaataaaactttggttacaaaaataggtggcaagtcacatttggactgtgggctgcagtatgccagccctgcaccagactagaaagaaggaaaggaaaaaatgaactaagaacaagggagacagctccaaaacaaatgggaaaaagaaaaccgtcgatggtaatactgcagtggtacctaaaagagaatattatagttgtaagatccaataaggtaatgagaataaatcaataaactctgactgaccgaacacatattctcccttgtgataaaataacacatattggtagaatgttctacttactataactactatgcaaacaaattcctattttgaaatatataaataaatatatagttcaaaaataggagttaattacaacatgaatgaaccttgaaaacatgctaaatggaagaagccagatggaaaaagccacatattgtatgattccatctatatgaaatgtccagaagaggcaaatccatagagacaaaaagcagcttagtggttgccaggggctagggacggggaagtggggagtgattgctgatgggcacagaatttctttatagggtgatgaaaatgttctgaattaattagtggtgatagttgcagaactctgtgaatatactagacaaccactgaattgtacactttgaaaggatgaatttatggtatgtgagttatatctcaattaaaaaaaggagtaggacattctcatacgatttggcactatctttctggaaggcagtttgaagcagtgcatattaaaagtcctacaaatgtgggaagcaagagagaaataggagctaagaagatttggaaactgaagagcagctgaaaaataaattatttcagtaactgcaatagctccatatacatcaattcaaatacaaaatgggttctattatgtcttgagagcaattaaaaggtaatattttgccttcccacatctgtggaaagtagtcatggacacctgatctgcttatatgagttaacaacagatttgcttggacatcaaatgattattgctgggtgtggactaggagcttttcatacattgctgatccttgccacagttctgcagattatgcattataaagcccattttacagatgagcaaactgattggcaaaggccatgcatcccttctgatctcagcgatctcacgtggatggtgcttctagcaggaggaggatatcagcctgcacctcactccttggacattcctcagctgttttctgttccctgaaaggacattgcaaatgaggccctgcaagcaagttcacaatgtcgccatcccgatttcagccatagcctcccaactggtctccctgctccctctcctgcccacatttgccagagagatctatttaaaactgaaatcagcccatgcccttcccctccttaaaaaaccaagctcctaacccctgtttagaagggcttagaggccccagctccattggctatcacatgggccatatcttgcccttgccctttctgcaccagcctatgggccttcctgtccatcaagccttggaggagcatcctagctcatgcctctgcctggcatgcccttcacatggctgacttgtcattcaggtcacctccacagagactgtccttgtctactgttctaaagtagccacaattcactctattttaatcctttgtaaagctctgaccatctgatattcttccttccatctcatcctcccttcctcttctcttctttcctcctccccttcttgccttgctccctttctccttctcttgctccctccttccctgccacttctctgtccactagaatagaagctgtatgagaacatgaactctgggctgttcacctgcccctggcccattataggcagtcaaatatttgttgaaagaattaatgaatgctgatgaaacttggcaaaggtcctgtgttttgctaaatgatgaaagatataaatcccacagcacatagtcttggctctgtagaagggtaacaataaatgagactaatgaccacaaacttcagaaggccctaacccataccgaccatttacaactgtccccacccccaaggttccatgtctgagacaagtttcagcctgaagtgagtttttattacctactcataaacccctgaatcatgtggtttacagggcaagtgctaatgcagtcataattatattggtgtgaacaaattgtcatagaaatgtagcaaacatagacacaggcatttaagagaaaccagctgctcacaacacaagatcaaccatcacatagaaaccagtcagcaagcacagagctaaggaacttgaactgagtgactgaaggtgacacaccctataaatcacaaagtgtgatgacagtttgcaccagcacctcagagcaaccaatactgcccagagcactatgcattttgaggaaatctataattaagacatggatactaccttccctaaatggtgactgccattctttttctgtttaattaaccgaagcacaaaattaagtgttaacttcagtttgtggacgatttcctttcttttctctttggaagcagatcaaggaacaagaaaggacatgactgcattataaattcattacttacctagggtgttttttttcctttttaatctctaaaataacagttgatccattaagagactggaaggtgaaaaatgtcaagcttctgaccttttcttaatttacacatatactgagccaatgaaaacatatccacaccccatctccccataattagtactttctgtggactcagtgatgactccagagcaggatttctcagcctaggcactattctcatattggatcagataattctctgtgtctgggctgtcctgtgcattgtaggatgttgagcagtattatccctggcctccacccacactggatgccaggagcatcgcaccttctccccccaaaatgtgacattcaaaaatgcctgcagacattgcaaaatgtcccttggaaagaaaaaccacctcaaggttgaaaaccactgttcaaaacattgtgatatgaaaagctaagaaaaaagatcaggttatactctaattatttttgtatttcaacatattctgccacgttttatttcttggacactataaacttgtcaacccagaatggacacttattgtccttttagcatttgttgctgtgtttgagtggtggatgttgctcagtgtcttgctaaaatgccacaaggccaggattgctcttataggacgactccctgacattcatcatagaattttatgctttcatccagcattgcatgccaagattacacttctttaaaaaacaaccagggcctacaaataattgcctctgagactcggcattattttcagttggtggagcaatcttaaaactggtttcaaaccagacatttaaagatcataatatttgtatgaagagttctttaaagagaaagaagagagctggttttagttggaaaccaatgaaaaaacaagtcgtttgtctctgccttttgctaaaataactaactttaatgacaatgtatttagaatagcaaaagcaagagcagaactagccctggcattggccttagaagattttacaactctgaaaaggccattaatcagcaaacaatctataaagacaacctaaaaaaatgtgttccaactgcctcattcccttgccttggttataatccaagagcaaatcctccaagtctaaatctcgtgacccataaaacttcttatctgcctttacttggtacaggccagcaaccaaatctctatacactgtttttcccatggaagaatgaggctgtaagtttgctcaccaagaggcacttggtgggaagaaagaataagcaagaaatctgccataaatcttcatcagccttcttgtgtaaagctgacatggatttagaaaaagtttgttcttcataaactttattatttgcccaggaataattttattctaattgaaaaagtgcattttaaaagctgtcaacaattgtgcatggatttttgacattgtacaggaagctggccaatgtgacacacttgtatggcatagtcacagtataatgtgattttgtttgctttcaaaattttcttgtatggtattttacggttattgattttacaccagatacgtatttgacatgaatggcataatttttttaagggctgtttacagaaagaagaaaattcagtttttttttttcagttttttttttaatgattttttttttgataggttaataaagtgctttgtgtaggccccgcatttttgtttgggccaaagagaaaaacagtcaccacagtccatcaatctgatttgtgattttgctttataccctctactagtagcttgcaccttgtgatctatttaatatcttgcctttcttattaataaaacccaaactaggccttgttcagggtgattggccagaaagaatatgcttcatccgagatggtaggtgcgtacctagcattcttctctaagaacaatatggttcaccacaagtgtggagggtggagtgtgtggaaagtctgggttcccctttctatgcttgaaggggccttttgaggttttattaatgacaatttgaacacacttcttttctatatatctcccatcaatgaattcaacaattgcttggggggcaggttgacattacgaacttagtttaggagaaggtgtctaaatgcttccaaataactttcatgtgatttctaaaataattgatcataaataatgagtatcttatagttataagtcaggaagattaatgatttgaaaacttcttgaataaagtgtggtgttgtctctaccccctgaccctgggcccccatttaaacaaagatacatctatcaacatattttttttgcaaaaatttgggtgctgattttaaagtgacctaatataaattaatccattcaaagtactacatattgaatatctgggaaagccagatatttaccatattctgtcttttattttcagatgtaaaatagttcaaaagctaattatttaaaaagtatggggataaaagtcatatttagagcggggcctaataaattgggcctgtccagcagagcagtcctcttcaattttgcctaaccactcacagagcaattcaccagagtttaacaattcactcagaattttcagtgttgatatcacctccgtttgcataaagaaccaattgactatcaccaccagaatagaaattctacaatgaatgccagtatgtgcattacaacaaatgccagtaagtgatttgccggagtcatgcagccagcaaggggctgaagcagaccttgaagccagccctgtcccagcacatagtcggtgctcctcccactccacctagaagagcaagtcaccatcacaagatggaaggctgctggctcccattgtgaggtcacagagaatggaactactgaaattagacccaggaattgttgaatagaactttccatgccctgatgtcaaagtaaacatatacatgatagatactaaggcattaaggaaatcatgagtcaacagtagtgcttgttaccaaatatagttggtaacaagctgtctccatgagacaagcaaacatgcaaaaacccacgttcgatgcattgttactccttaaaaatctccccagtgcagtccagtcaatcctgttttcttctccagactttgcccatcagctgttctttattatctctgttatttaaatgaacagagagcaggcattgagtagggggctggctttgaaagtgacttcaagtacagtcacagagctgcaaactcagctgctgctgttctgaaacagttattccattttgttatcaatgcttagaccaaagcgggcatggcaggttgctgcatttgcagtggggcattgctgatggggccttgcaaactgtgtctgtgacctgtagggtttctcatgttctcttttcagagcaattattctccaaagctccactccccaaaatgtgtccctgcaggattcctctctctgctctgttcctcactaggttcatatctttgctatagtacttgtcacattgcattaaaacatcttttgactactctgccttgtccacgtgactgggagcctatcaaaagcagatatgttgctcattattttggattgcctaagggtctggcaactgcgtctggcatgtattgatgctcccctcctctctcctagtttgctttatatcctatgaaatgtctcatcagaatcctttaactgttattgattcaagtctctacccagttttgtgacagcaatttagcactttgatctctcaccccattttgcttctgttattaaatttatttttccatgaatttctacttcaagtcggaaagatgaagaagaaaaattctgggctgtgaagtcactagccagctgtgtggcaatggacatctttacccactctgagctcatcagtccccttatttatatttctaaggagagggagtgggaggagaagagaagggaagagaaagtaggaaagaaaagaagggaaggaaggagaaaaagaaagcaagagcgtctgtattgtatggttgttgtaggaattttagagactgtcttttgtaagcaccatcatttaacaggcatttattagatgacagctatccatttttgtgtttctcagtctatcctggggccaaatagaagacacaccacatattggggtaagagaagatggatctttgattctttgtcaccatgatggtatttgtgggtgaattttttttcttcttcatgttgactgtcattggaatttttatgtatagagtaaattcttattatgtctagttcttattggtgttataatcaaccttctaaaatgtctaatattagaaagcagcatggagttgagggcatcagatcaacactcatttcaggcacaacctttttcatcccccctcacctggcaggccaccagtgctaatattactggtacgtggctgatgctactttggtttctgcagacagctcaaatatgaatttcacttgtcctttttccgtttttttcacctcaagcaaataattgacaagcaggctagaatgtcttttaatcacataatggtcctcaaaaattgttttaaaggaagtagtactgagtttagacaaagtaatcaattactgtgtagtacacagaatgtaatgagggacaacaaatactttagagttggaaggcaacttagatttctatttgtgcacataggccatggcatgaggatagcagaaaaatcttatgacactataaggccagatccgagtcctttggtttattttatgaaaatatcatgattggaaaccatgaatcatgtaatgaatgctgggctaatcaatgtgtggttctggtgtgatattacaaaaatcatgacaacttaacatatttctagaacttccaggagatttatggcaaggttgagatacctaacaggctgatctcaatgtagccttaagggaggtgaagggatattaacatgcagtagacactcacacccactatgtgggagaccaacaggtacttttcctatatacttacaactgctaggcaaagccaatatttttattcccatatttcccaaagaagaaatttcccaaaggagacctaaagaagtcaagaaacttacccaaaactagacttattagaagtagccaagcagggatttaaactcatttctggctctagaaatatttttgatttcctagtcttttttttttttattaacaagacgcaaaattccctaattctactacccttcagaccactataaatgctgtggtagatatctccaagatggcaccaaatggtccctgcctccctagtattcacaacttggtatttccctccccttaagtaacttgcttctaacttataggacatggcaacattgaggggaatttatttccataattcatcaaaagacattgtgacattcatcttactagcagactctcaccctagctggctgtgataaagcaagctggcatgttggagaggcccacatggcaaggaattgagggtggtctctgggcaacagtcagtgaggaaatagagccctcagcccaacagcccccaatgaactgagtctgccaacaattacatgagtaagctcgtaagcacgttattccccagtcaggtctccagatgagatcccaggtttagtggatatccggatcacagcctagtgagaccctgatcagaagatgcagttaagctgtgaccagattccttacccacaaaacctgagagataataaatgtgtgatattttaagcctctaagttctgggacaattcattttgcagcagtagacaactaataaaaggaccccacaaaaaggcaattggcttgccacatgtagccaccagtgtgagacccatggaagataatgatgctagtttttgaggtgacagatacctcaactctcctactacattatacgtagaaaattggctaaaaacaatacacgtgaacacactgttccctgggcctaattcctttgctaatttctgtgttagatgcataaaacagagagagtgcaaccaccaggcagagaaacagtgagctaatatgtagatataataaattaatataaatgaacaaagagcaagtacatactgagtgacaggagttttagaaataatttgatttagccaggctggggttagagagaattccagcctaaatagagatgtaaaactagaagatgactgagttattccctcaggaaccattttggtattctggctggttaggggagctctatttgactcagctacatcatcaggaatagttctttgagttagaaagtttctatttttacagagcttttattttttgatgaatggatagtcaggactcagattcaaaaaaaaaaaattctggcccaattacattagtagtacaagaaattatgttatttcccttggctttaaaaagtagtcaaagcttatgtggaagtaaaaaaaaatacttctatttgtttgattttatttctttcttcatttacggattgacctttgtgttcaatatcaatttcattatataaatattagatagaaatgacactgtttgacaatttccatactaatagaaatcacagctttaaacttcataaacaaaatacagagatttataactttctgttccaaggtccataacttattcactatactaagtgaggtctcatcagcactatttctcagtaatcacaatgcagcctttggggttaagtagccctgagtttgggaattctggtcaattcacttactcaccaggtagccttaaccttcctgactctctgttttataatctataaatggggataaatataatgtccttcaaaaatgaaaaaaatgggaaaaggactccatagtcaataaatggtgctgggatagctggctagccatatgcaaaagaatgaaactggacccccacctttcatcatacacaaaaattaactcaagatggaataaagatttaaatgtaagacctcaaactctacaaattatataagaaaacgtaggaaataccctttctgacatcagctttggcaaataatttatggctaagtcttcaaaagcaattgcaacaaaaacaaaaattgacaagtgggacttaattaaactaaagagcttctgtacagcaaaagaaactatcaaccgaggccagcacggtggctcatgcttgtaatcccagcactttgggaggctgaggtgtttcagatcacaaggtcaggagattgagaccatcctggccaacatggtgaaaccccatctctactaaaacacaaaaaattagccaggcatggtggtgcacgcctgtagtcccagctacttgggaggctgaggcagggaaattgcttgaacctgggagatggaggtgacagtgagccgagatcacgccattgcactccagcctggcgaaagagcaagactccatctcaaaaaataaaaaactaaaaacaaaacaaaaacaaacaaacaaaaactatcaaccgagtaaacaaacttacaaaattggagaaaatattcacaaactatgcatctgacaaaggcctaatatccagaatccataaggaacttaaacaactgaacatgtaaaaaaacaaataacccatcaaaaaatggacaaaggacatgaacagacacttctgaaaagagacatacaagcggccaacaaacgtgaaaaaaatgctccatcagagaaatgcaaatcaaaaccacaataagatatcatctcacaccagtcagaatggctattattaaaaagtcaaaaaacaacagatactggcaaggctgcagagaaaaggggatgtttataaactgttgattgttgttgggagtgtaaattagttcagccactgtggaaagcagtttagagatttttcaaagtatttaacagagaactaccatttgacccagcaatcccattactggttatatatcccagggaaaggaaaccatcctacaaaaaagacacgtggatatgtatgttcattacaacattattcacaatagcaaagacatagtataaacctaggtgcctatcaatggtggactggataaagaaaatgtggtacatttacaccatgaaatactatgcagccataaaaagaatggaattatgtcctttgcagcaacatggatgcagctggaggccatcaccctaagtcaattaacataggaacagaaaaccaaataccacatgttctcacttataaatgggagctaaacattgggttcacatatacataaatatgggaacaatagacaccgggtactattataggggagagagagggatgggggcaagggctgaaaatatccctgctggatactatgctcactatctgaatgatgggatcatttgtaccccaaatctcagtgtcacacaataaacccatgcaacgaacctgcacacatactccctgaatctaaaagttgaaattataaaaataaaaaataaaaataaaacaaccatagagatattttagaaagcaaaaatataaataaatataaagttcttgagagagagatttatacataaattaagtgacataagtaagatgcttatattatgcttcatacataataaatagctgttactatattttcttttttttttttttttttgagacagagtcttgatctgtcgcccaggctggagtgcagaggcctgatctcagctcactgcaacctccacctcccaggttcaagcgattctcctgcctcagcctcccaagtagctgggatttccggcatgcaccaccacgcccggctaatttttgtatttttagtagagacggggtttcatcatgttggtcaggctggtgttgaactcctgaccttgtgatctgcccgcttcggcctcccaaagtgctgggattacaggcgtgagccaccatgcccggccagctgttactatattttcaagattttggtattgtctttagttttctgtagtttgaatatgatatggctaggtgtagactctgggtatttattctgcttcatgttctcggaacttcctggatttgtggtttggttcctgttattagttttggaaaattctcagtcattattatttcaaatattcaaatattcaagtatttttttctactcccttctttattcttcttctagtattcccattatgtgtatgttataccttttgtgtttgtaatggtctcactgttcttcaatattctgttcctttttttaattctctttttttggtttgcatttccatttgggaagtttctattggcatgtctttcacctcacagattcttttcttggccatgtacagtctgtggatgaacccatcaaagacattcttcatttctgttacagtgtttgtggcttctataatagcatttccttttgattctttcttagaatatccatttctctgtttacattatccatctgttcttgcacattgtctatttttttctaacagaacctttagcatattaatcatagttagtttaaattctcagtctgataatttcaaaaatgtctaccatatctgaatctggttctaatgcttgctttatctcttcagattgtagtttttcttgccttttagaatgccttgtaatttttttgttgaaagctgggcatgatgtattgggtaatagaaactgaggtacataaataaacctttagtgtgaagttttatgttgatctggctaggggttatgcatgtttactgtttgctgtagctgtaggtgtcataggcttagatttcctcaattatctttgtcctccctcacccattgtatctttacgtttccctagaaactccttcttaaatcgagtttgagtatttccgttattttgcttgtaattcactgtcattatacaggagcactgttgatgtggttataggatgtagggggaggggaagcattctataatcctatgattgggtcttaatcttttattatgcttgtgcccctgggctgtgaccttcacaagtgactctcagcttttatttttcctcttaggtgagacaggaaagctacagagggctggaataaggtaatttttcttctaccaagtcagataaggctctggtaaattcttttcccttgttactgattctttcttttgtaaacaatgctctgggcttatttcaaaatggttactttcatatgtccaaagtgttacttttccttcttgctctggccaagcactaagtaaattttttctaatcttcaccatgagaaccttgtggggggaatcctagaggtaaaacccatgaaaatgttgggatcccactgaaattaggctcccagtagtttttttttgttgttgttgttgttaattttattattattattatactttaagttttagggtacatgtgcacaatgtgctggttagttacatatgtatacatgtgccatgctggtgcgctgcacccactaacttgtcatttagcattaggtatatctcctaatgctatcgctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctataaaggacatgaactcatccttttttatggctgcatagtattccatggtgtatatgtgccacattttcttaatccagtctatcattgttggacatctgggttggttccaagtctttgctattgggaatagtgccgcaataaacatatgtgtgcatgtgtctttatagcagcatgatttatagtcctttgggtatatacccagtaatgggagggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatggtgagcattttttcatgtgttttttggctgcataaatgtcttcttttgacaagtgtctgttcatgtccttcacccactttttgatggggttgtttgtttttttcttgtaaatttgttttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctatcgtttaagtctttaatccatcttgaattaatttttgtataaggtgtaaggaagcgatccagtttcagcagtagtttttaactacttactaaagctagtccatacttagtgaccagaaattcatcgaagttactatttaagtgttcctactgctattaggcccaatggcttctgcttcaggtaaactgatctatattctctggatttgcttgcctgtgcagtttctggggtggcagtttgtactatgacctcaattctctgaaggatctaagacaagtcattggttttcagtttgttctgcctttttcttgttaagagggcgggattgatgactgacatgctctttacattttggaatgaaaaccagatgtttctgatgttactatattttaaatttatgaataagttacactcttctcaactagaaagatctataaatctagagttatacagctccagttgtccaaatgtgtttctatcagggcacttaagtttttcacattatcagtcagatattattgtatgaaacaatttagaaacatataaacaactgctcctttctggtaactacgaacattactacagttcatttgcaaatattcctttcaactaattgaatggcaactaatgagctaaaataagaaagtaaaatttcctcaaattaaagggaagatggggagggaattattttcctattcagaattaaaaaaaacatttaattagaatactcatttaaaacattagttctgaaggctgggtgcagtagctcacgcctgtaatcccagcacttttggaggccaaggtgagtggatcacctgaggtcaggagttcaagactaacctggccaacatggtgaaaccccgtctctattaaaaatacaaaaaattagctgggcgtggtggcaggcacctgtaatcccagctactcgggaggctgaggcaggagaattgcttgaacttgggaggcggaggttgcagtgagtggagatcatgccattgcactccagcctgggtgacagagcaaggctctgtttcaaaaaaaaaaaattagttctgggaactcttaaataaagacaatgacaaatagcatattggttttctgttgctgcacaacaaattacaacaaatttagcaaaataaaacactttctattagctcacagttctgtaggcttgaagtctggataggctcaactgggttctatgccgagggtttcataaggctgaaattaaaatattggccatcctgggctcttacctggaggctctgggaaagaatccacttccaagatcactcaggttgttgactgaatttagctccttgagttgtaggactgaggtcttcatttccttgcttctgtttgtggagggttgctcagctcctacaggctgcttttccatccttgcacatgacctcttccattttcaaagccagaaatggtacatcaaatctttctcacactttgaatctctatgacttccccttctgccatcagccagaaaatgttctctgcttttatgggctcatgagaccagatggtgtctacccagataatctccctattttaaggtcaactgtgctgtataccttaacataatcatgggagtactacctcataacattcaaaggttccagggattcaggtggaacatttttggaggcacatcctagaacttctgcctactaccagtgggtatccaggtctcctaggataggggaggccagaaacattcagcacattggacactttaacaagaactaggctacttcagtctgcagaacagaagaaaggggtaacaggttctacattcttcaaagactgcatgtagaagaaatgcttatacacgcattcactccacaaacaagattgggttcctgtcaggtgccaacacatgtgtcagatgttggaaatacaaagatgaataagacccatttctgttctcagggagctcacaatctcatgtccagacaggagaggctgaggtgaaagcctctaagatgtccttgtctgatagacttctctagaatgatcctatgctgtccttctctgtgattaaatgatatctgataaccattgaatctcctcctatgatgtccctctctgtaatggtcctctatgatgtccctttgtacgatgcccttatctgtgatgagccgatgatgcatttaatctgtgatgactctatctatgctgtccctctctatgacacttgtctctctagcacccctctctgtggtgctcttcattatggcactcctttctatggcaacccctctctatggagcttctctctctggtgcctctctctatggtgctcctctctatggacccctctctatggtacacctccctatggtacacctccctatggtgctccttttcattatatctatttctaggaaaccatcctctaagaggctggctttaagaagctccactctgactgacaaaaacaagcaatggggaaaggattccctatttaataaacggtgctgggaaaactggctagccatatgtagaaagctgaaactggatcccttccttacaccttatacaaaaattaattcaagatggattaaagacttaaatgtaagacctaaaaccataaaaaccctagaagaaaacctaggcaatactattcaggacataggcatgggcaaggacttcatgtctaaaacaccaaaagcaatggcaacaaaagccaaaattgacaaatgggatctaattaaactaaagagcttccgcacagcaaaagaaactatcatcagagtgaacaggcaacctacagaatgggggaaaaattttgcaatctactcatctgacaaagggctaatatccagaatctacaacgaactcaaacaaacttacaagaaaaaaacaaacaaccccatcaaaaagtgggcgatggatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattcaaaagtcaggaaacaacaggtgctagagaggatgtggagaaataggaacacttttacactgttggtgggactgtaaactagttcaaccattgtggaagacagtgtggcgattcctcaaggacctagggctagaaataccatttgacccagccatcccattactgggtatatacccaaaggattataaatcatgctgctataaagacacatgcacacatatgtttattgcggcactattcacaatagcaaagacttggaaccaacccaaatgtccatcaacgatagactggattaagaaaatgtggcacatacacaccatggaatactatgcagccataaaaaaggatgagttcatgtcctttgtagggacatggatgaagctggagaccatccttctgagcaaactgtcgcaaggacagaaaaccaaacaccattcactcataggtgggaactgaacaatgagaacacttggacacaggaaggggaacatcacacactggggcctgttgtggggtagggggaggggggagggatagcattaggagatatacctaatataatgttaatgggtgcagcacaccaacatggcacatgtatacatatggaacaaacctgcacgttgtgcacatgtaccctagaacttaaagtataataataaaaaaataataaaaataaaataaaataaaataaaaaagaagctcctctctgagaagccactcttttttttaagtatttttaaagttgtggtaaaatattcataacgtaaaatttaccatttagcccttttaaagtgtacaattcaatgacattaagtacattcacaatgttgtataaccatcattaggtacttctggaagtttctcgtcatcccaaacagaaactgtgttcattagacaagaacttcccactcttccttcccccagctcctggtaatctctgttctactttttatctctatgaatttgcctattctagagaccttttgtaagtggaatcgtacagtatttgtccttttctgcctggcttctttcacttagcataatgtcttcaagttttatagcatgttgtagcatgtgtcagactttcatttcttttaaaggtcctgaataaaattccattgtatgggtatatcacattttatttatccatttatatgtcaatggacacttgggttgctttcactttttggctattgtgaataatgctgctgtgaacactggtgtacaagtgtatgtttgagtccctgctccctgctttctattcttttgggtgtatacctaggagtggaattgctggattatctggtaattttatatttaaattttgaagaaccacaaaactgttttccacagtggctgtacaattttatattcccaccatcaatgcatagagttccaatttctccatgtcctcaccaacgcttgttgttttctctgtgtgtgtgtgtgtgtgtgtgtgtgtgtttgatagtagccatgccattgggtgtgaagtggtagctcattgtgggcttgtttggaagccaccctttaaaatgcttttttctatgacgttcctgtctatgatgtactcctctctgacacccctctttgatatccctctctattattattttttataataccgaccctctctatagtgtccctgtctgtggtgctcctctgtatgatgcccctctctacaattccccttgtgccctttgcattttttcctcctgtatggtccccctatcagtagaatgagctatccttctggggatgatctccttttcctgggggcattcaaacaaaggcaagatggccagcagtcagggttgctgttaaagagatttctgaggtcacttatgactctagcttatgacaacaatgtcatcatcttttcagtgtggctttgagctgttcttccagcatctgagatgtatttgtactgactcattcagacaccttctgtatctgtccttctccatggccagtggcatagtccatgaaaaaattactgagtgcagttcgggttgctgcctttgactgcgtaatttggttttacactcatttctgcttttttaaccatcactttgtatagtagttgctatgagccaaagactgttgtaagcattgcataaatactaacacattgactccatttaattcctgttttacggatgaggaattgaaaccagagaagttgagacacttctgtctgctaacacagtgtgtaagtggagaagctgggattcaaactcaggttgtctggctctcaagcactgagttgaaaggtcaacaaatgttttttgaagattgaccatatgctgggtactagacaaagatacagttcttgtgcttattaaggagtcaggtccagaggaagagagaaatgttcattgatagtgattctgatgcccaggattcatgaaggtgagtggtgagaaatatggctgagaaggtagacaagagctagatggagaaggagagccttgccaggattggactttagaatcatgtaagatcagactaggactgatctgtgatgaaatttccaacaaggtgtagtgaaatgaagaaaatgtaggcaatttaatacattttttcataaagctaaattaatttactataaaaggccgtcctttttcccaagattacatctttcttatattttttgatggcaaaatgtccattcttttgatattttggaggtaagaaggtttttttgttatgtcattaatggttaatttaaagttggcaacccatattaacttctgccattaaaaaataacattagtccctgaaatttgaaaatctgggaatcaatgccataagaaatatcggaacaaagcaatacaaaatatcagtgagaggtcaagtacagtaaaagctaaagtgctgaatagatttggccatgaggaagtcatcagccacattatttgggggcagttttgacagggtgatgcggtgggaggcaggctatggtgggaatgcataagtctcatttatctctaggcgacaaaacttgggtggtcacacagaaaaaatatgtattggctcattacatgtatgtgcttatgttcttctggttgataggctgccacatatttaagacaggtggaaaggaaagagaaatgacaaagaaactaatttaagcgaaggttgttaagcaaaaagattgacagactctaaaattacccactcaacctgatgaaaaaagtattcatcacttttcctctctctctttctctctcccttggtccctctctctctttcagtgatgccaatatcttcctagatcagaaactagatgaacatcagcatcctaaaaatctaagcatctctatgagggatcaaagtcatgttcagggacacatgtcttcaccagcatgcgagtcattccattcttgctctgcctggcccagattgaggaagacatctgagactggactttatgtccgttccagagagtgtacagcatgaaatactgtccttccggctgccagtctgacttggcctgagagaaattgggcgagaagcatgcccaagtctccactgaaccaatgtggagagttaatcacaagttagggcactttggattgaacgttcatctatgatgaactggcaagccactctccctgtgtgttttcccttcagactgtatgatttcagtgcaaaggttgtcttagaacctgaaaacccagaaacattttcaaacctgaattggcctattctcggagactagtgctgagtctactgggataacatcaatctgcaggtttttcccagcactgaagacatagttcatcctataattggaaaataatttgatttatattccattgtgtcagagccttcactcaggtctcttggaggagaggtctaggcagcaggaagatggtctagttttgaaaaaaaaaatgctccatagacacttatggagaaagtgcaaaaatggagcctgagtgatgtttatgaaagaattccaatgcctctttgtagattcccgagttagattgagggatgtgaagcatggagagcccagacacaaaaacagtgtaatgattggcctcccatcctggaacttgcatttgctgggtcctgcctactacatgccaggcacttgacataggagttcattacatcctctcaatgccactgcaaatgggtgtaattatctctatttttctaaagaagagtaaacaaagtccagaaagatgggtaacaaagtccagaaagatgggtaacttggcccaggtcacatagctggcaaatacccaagtgataatttgaacctgaacccaagtctgccttactcttagaccacatcctttcctgtgctccaaaggctgagtttgtaaagtgtgatggatgcctctgctagaagtgcagagtatacaagcagaacaacccaagacacatgctattgattcaggcagttgtactcagggcattttcctgtggagtttatgctggacctactagcatcattttcctcatttttctcagggaatgcctggaaaccaagataattgctcatcagaactactttaggaaacccaagtggcaatgggggaccctcttaacctagaaaattctgggaaattatccctctcatgcagaggttggcaaactttttctctaaagtgtcaggtagtcaatgttttccgcttcatgagtcagaaaaatctctgtcgcaactactcaactctgctgttgtagctcaaaagctgctgcagacaataattcataaatgaatgagtgtggctgtgttccaataaacctttaaggtcactcaagcttgaattttgtataattttcacttgtcacaaaatgttatttccttctaaaatttttttcaaatttaaacatgtaaaaaccattcttagctcacaggccatacaaaagaggtgggcagtgtggatttagcccgcaggccatagtttgccaatccctgctccagaggatcatattttattttatttttccccatatgttagatggtttactctcagaaggtttacaaaagtagacaagaagatctgttgataattaattagtgaaaaactactgaatatagcttgacattttaaatcctattaacaacaatttttggccaccagaatgactcacagtaaacaaaattccttattactttttttaaaaaaactttcttttaattgaaatttcaattgaaataattgtagattcatacacacttgtgagaaataatatatagagaccccttgcacccttcacccaggttccccctatggtaacattttgcaaaataatctaccaattttgtccagatttcttcagttttgcttgtactggtgtgtgtgtgtgtgtgtgtgtgtgcgtgtgtgcataagtgtgtgtgtgcgcatgcatgcacatatttagttatatcactgcaaagatccctgtgttgtcctttcataactatgtccacctccctcctgcccccctatccttagctcctggcaactactaatctgttctttatttctaaaatttggtcatttcaagaatgctacacaaatggaatcatatagtatgtaattttttgacactgacttttcattcagaatattcccctggagattcatccaggttgttgcatgtatcagtagttaattcctttttattcctgcatagcattccatggtaaagattaccattgttggtttaatccttcatttgctgaaggacatttggattgtttctagtttcaggctaacatgaataaagcatctctgaatgtttgtgtgcaggttttttgtgaacatttcatgtccctgggataaatgcccaaaagtgcaatttctggtctatatggtaatttcatttcatatttattactttttaaatattccctttgcacatattttaaaatatgcctttttaacattaccacaaaaacacaccctataacaaatgacaccgtggtaacagctctttaaaaattccctgccatcttgcattctcattttatagacatagcaactctacactagagaacttaactgaccccaaagggtcagtcataagtcacagaatggtcagtgcaagctgagccagaacaagaaatcacttcttccttgtcttccattagtgctcacatctaaacatgctgcaccagtgaaattacagacagaagcagccaacgacatggtgtttctcattatggaagaaagaaaatggtttacttggctcttagggatgtcatgagctcacatgtcctagctacagccttcctcaatggagtcttacgtggcttcttcactcaaaacttgagactgcctcacagcatgggcaagtgacaaggaatagcaaagtgcaaacatgcaaacaatgtttaatatttctccagtgtgactatgggaactggaaaccctaaagctctgtgacacttttcatcagtcccctgggggttatgcagctgtgtggttaacaagttgactatactgatcagagagggttgaactagtattgataaattacaattcctcaaatctaaagcctttcctgacacgttttctaaatggtccaaagaagagtttgtttcatttctacattagacttagcaattggtttcttcagtctactggccatgaccaagaagtgcaggaatcctaccatctttcactccctcctcagaatctaggagccattacaacaatccgtccctacctttaaccagtgctgcagagggaggtctgtggaccaacagcatcagcatcacctgctaacttgttagatgtgcagactctcaggcttcattctcagaatggttgaatgaatttctgtgactgaggcccaccaatctgcttctttcctagctctcactcggagattctgaagctcactaagccactttagaattaatttcaagtatataacagaaaagtaagtcatagtttttaaataaattaataataataataataaaagctcaaccaacaaaatagttccagcccctttctgtcaattacacagtctttatgaggccaatattgatataaacataaaccagagttgttatttctgacattcagcagattgtaactttcttcacgcattcactgtttgtttctaatgaaaatgctcagtttgtgcttctacttagcacctatttaaaattctttatcaaactgtaatttcctcggaggcaggaaacgtgtgtctccatagcctaataaataggtgtctaataaatggttgtttaacaaatgaatggattgtgttttatattacagttgctttgccctccactaaacagtgcacttacaggttggagaagatgagggttttgtttgtgctgggttcccgaagattttctcactatccctaagtatgcagctgacttctctgaatacaataggttcacaaaagttgttggatgcacaacaacaaccaactaaattgcacctttagtgttactgcatagagtccaaataattttaccatggacattatttccatgtacatgtgggaaaaagtaatttagtattgccattttgaatattgtttaagaaacatcattacctataaaatggaacttgagagcatgtttggggaggttcgtgggtgaacaaaggtacctgtgacagatgtacctcctttcaaaagggtttgtcatggaacaatgaaggcaaaaagaggcaatgatactcagccaggtgagccagtgggccccagcatttttactgaaattttctagttaagaaaccaaattacacaggctcattagatgatccaaattccgacattcaggtaggatatttcaagccctttgatgttgaacttttaggtgtatctgccttgttagttattctctatgaatgagagtatctggcacttccacagaaaggtggaaatgacaaataagcacctttgaaggatcagatatgtgtgaaggaaaaacacagtatctgtgctcaagaatctaagataacttagcaaggatgatctgtgctctttaatttttacatatcccatatgaaggatgggaaatgctaagtgttttcctcagtggtcttagttataaaacattacagagggattcaagttttataatccacctttcagcaaaacaaacaaatcatttgtctgtgctttggaatctaagaggaacataaagcaaaattagatatgtttatgataggtagacttcagcaatgaagtaggagtttggaaaactcctacagtcaaccctaggatgacttcaatggatgacttcaacatgattttctttcttttctttttttctctttctttctttctttctttctttctttctttctttctttctttctttctttctttctctctttctttctttctctctctctttcttttcttttttctttctttcttcttttttttttttttttgacagagtcttgctttgtcatccaggttggagtgcagtggtgtgatcttggctcactgctacctctgcctcctgggttaacgtgattctcgtgcttcagccgcctgagtagctgggaatacaggcgtgcgccaccacgcctggcaatttttgtacttttagtagagacggggttttgccatgttggccaggctggtctcgaactcctgacctcaggtgatccgcctgccttggcctcccaaagtgctggggtaacaggcatgagtcaccgcacctggccaacatgattttcttttccatcaaaatgacatttccttgagaatgacaagaagagaaaatggctacaaatattaatttctttcattctatattgctgccatttttgtatatttataagaataagattttgttgttgattagggtttttgctctatcgaaataacatcttcaggacatatatatttcttaaatgactaacatgtttctgatccaagagtacatacaaaactggactgagtataacattatcttccaaataaattttaactttgtgtttaatttgtttaagcatttttcacagaatttgtctccagacaaaactcttaaaagttagttttgagtcaacacgttacaatggttgcctgaaatcactaactattttagtactgttaattcaaattcatttgagcagtatttcacatgcaaagcttcagactcatccagtctcagaatgattctttgaaggcataaagctgtcaattatgaattaaatggacaaggtgatagaaagtaaatgtctaccttcaactctggcaggtcattgtttctacatgctatcagtgtttttcattagctgtattaacaaagacatcttaagtcctgcctaagtccacaggcctctgaaggaagtctaaacaactttgagtgatttggagtggaagcagtactaagcaacaaattcaaaagccttttggtgggcaccctctcccctagaggtggtgtgttttgccagatttgtccttcagagtgacagttccatggttcacaggtttatcaaatactaagccataaccctcaaagagctgggaggggatgatattagccagcatttattgagtgcttcctctgttcagaatactacacatacttcttctaatttagtcttatcaaatgactctgagaggcaggtggtgaaagaaaccaaggttaggaagttaagtgttaggagtaggaagtccagctaacaagtgacacagtagagattctaagttaggtctgtgtagctcaaaagtttatcctcctaacctctgtgccattctgcaggtcatcacagggcattcaatagctagtgatggtggccatggcaaattgaggggtgtgaaaaccagagttattttctacacctttccttagctgggatgggaagcaacacatatatacattgattttattttggtttatttatgaggggataatttgtattgtgtgtacatgtgtacacattctctctctctccctccctccctctttctgtgtgtgtctctctttctctctgtgcacatgcgtgagaaagacagagacagtgagagagagagagagagagagagagaaataatacttagaagtattgaaagtttgaagacctctcatctagtctcttcaactaattaaatgaaattaatttgtattgtaacttatctcccttatgcatacccatctatttgtaacttgagaaagactatattcttaattgttgcattgcaattgttaaatttattgcaaccgaagacatcacatttctctattgcatatttttatctccccagtcatgagacagtggatgtcctttatcctcacctccccctaattgtttccctttggtacacactctttccttccttcaattttcataaattcaatagtcaggacccagagagagcaagaaacaaatagatgctatgtggaataaaaccattacttcctgacacctccatatttgttctttctggtctcttggagtctcccaattagttcttgtcttaattttctggcaaatttcaggaaccctcacaatcttcaaactatcatcttccaatattcttctcttgggaattccctggaaacttcctgccaatatgcaatcctaggacctgagtaagagccatattttattgactatgagagtaatcttccagatggcttattttgtaacattccgcaagctataggactcagtacgtataggcatgtctccccaagcctttctaatcagtgggctaaggagagacattgttctattcattataccatatgccaatcccttctcaaatctgggatcataattgatgggttttcttttttccataggccaagcttttgtttcatggctctcatgttcttgagcagccccattggcctcaagccctcacttaccctaacagttagataatatcacccatcaaggagtcctaaaatgcagtccattgacattaaagtgatagtctttgctgtcctaaagcttatctgtgctggacacatgcacagcctggagggcaaatggattgttcagcagcttgccagggagagataaataagcagtgaaggaaagagcagaccctggcagggcaaaccgaactgggcaaatccataaagctacagccagtgagcaaacaacagcagtcttatattcagtcactggaaatgtgaagtttcttttgacctaatgtgttaatgtgaatctatgattcacacagtcccgaaagacaacacattttgcagcaggccgaggaacttttgttataatgtcatctatggaaaagatcaggaaagcagaaaatatgatctttataatgtttgtgtacctacagggccaattatctattaaacaatcatatagagtgatcatttcagggaaacactaaaagagactttaaaaatagtcagtagattccagtgatttacgtcataaagaaacagaccatcttaagtaacacatggacataaaagcaagcagatgtttgcattctaaccagggcactaatggaggtgctgtggcattgtatcaaagtaaagtttgccatcttcagaattgcccactggagttttaaatacagctgtataactttgagtcaacaacttgtaagcattccccgaccactctgagcatcattctttgctgcaggtaagaattaataattcatcactaacacaccgtgtcaaactcattttctgaaacaggcctgaaatgtgtgattgactataacatgaaaatttgtcataaaaacaattccttgggttgctgaattgtaaacataagttattatgagcaaaatcacagtaaaaataaatgagcaagaccaaactcacaagagactggatttgaaatttcacatgcaagctgtaagcctggcagttaccaactcaagcgttgggtactctgtaaagcttgacagtaggaatggatccagatactatggccttttacctttcttctggagaaatttaaagcatttttataaatattaagccagatactgctcattcaataaatgactcctggaagtatagaagacatttgtggggattaactctttaggccaccaagctatcattcactgcctaagaataatcttttttaaggtagggagagccaaccttttctggaacacctcacagcttagaaggcccagattcttgccactcaagccttttcaagtggggacatttaaaaagaaaattgcacttgcactactattgtggaataggactaattacaaagattaaaacagccttgtcatcttcaggggttagtttcactgggaaaaaccctactaggacactagtactaagtcactcacccgttggctggctgttttggcatgtggactaacaacactccctttgtcttattcttgctttcttctaattgcccactttcacttttgtgctgtttgctcctcctttcgtaaagatacctaaagaacaatatatttttagcatccaccagctcaaacacaatgcccgtgtttgtctcatttcttattttttgatttgttaatgtttacttttcatttcttactttcttctttatttatcctttttgctgatttctttaacttgcaagcatttccccataaacatatttctcaccctttcttttgttttcttcctttctctctctttctctttcagtctccaatattttctagcaatttgtggcttgcctcttcttgatcccttagtcctgcacctgtttgtttgctgggcttttgtttatatatgggagatgggcttggctggagaaagcagtaggtttttgttgctttgggacctcccttcctctaacatctcttgctgatcttttttttctcatttttttttcttttcttttctcccctgacctctctggtcttccacttatcttgtaaattattatacttgatcttaaaaaattatggcattttcgcagtaaccaaaacagcatggtacttgtacaaaaacagacacatagagcaatggaacagaatagagaactcagaagtaaggccacacacctgcaatcatctgatctttgacaaacctgacaaaaacaaacaatgcggaaaggattttctatttaataaatggtgctgggagaactggctagccatatgcagagaactgaaactggaccccttccttataccttatacaaaaatcaactcaagatggattaaagacttaaatgtaaatcccaaaactataaaaactctagaagaaaatctaggcaataccattcaggaaataggcacaggcaaagatttcatgatgaagatgacaaaagcaattgcaacaaaagcaaaaattgacaaatgacatctaattaaagagcttctgcacagaaaaagaaactatcatcagagtgaatagacagcctacagaataagataaaattttttcactctgtccatcctacaaaggtctaatatctagagtctacaaggaacttaaacaaatttacaagaaaaaaacaaagtaagcaaaggacatgaatggacacttctcaaaagaagacatacatgcagccaacaaacatatgaaaaaaagctcaacatcactgatcaagagagaaatgcatattaaaaccataatgagatatcatctcatgccagtcagaatggcaactattaaacagtcaaagaacaacagatgctggcgaggttgtagagaaaaaggaagacttttacactgttggtaggagtgtaaattagttcaaccatcgtggaagacagtgtggcaattcctcaaagatctagaggcagaaataccatttgagtcagcaattccattactgggtatataaccaaaggaatataaataattctgttataaagatacatgcacacttatgttcattgcagcactattcacaatagcaaagacatggaatcaacccaaatgcccatcaatgatagactggataaagaaaatgtggtgcatatacaccatggaatactatgcagccataaaaaggaatgagatcatgtcctttgcagggacatggatggagctggaagccattatcctcagcaaactaattcaggaacagaaaaccaaacactgcatgttctcgcttatacatgctaactgaatgatgagaacacatggacacattatgggggaacgacacacactggggcctgttggggaggtggggggatggagagcatcaagaagaatagctaatgcatgctgggcttaatacctaggtgatgggttgatctgtgtagcaaaccatcacggcacatgtttacctatgtaacaaatctgcacatcctgcacatgtacccctgaacttcaaataaaagttaaagattaaaaagaagtatgacattttattttcttatatctttcatctaacttcaaaaaaagtaaaaaataattaaagcttaccctccttaaaatagaaaaacgttcaaatggacacatacagttgcatgtgtgtgtgtatgtgtgcgtgtgtataatacatatataatatatataaataaaatgtacatagaaatgtatataaatatgaacagtgttgctttatcattgatagtgaccccagtaaataaaacaagaactggttgtactaacaccaatacatggaaataatctactagaactacacaagccatgaaatggtcttggaagcgacaatacagattaattcttttattttggaatatagcaatatgcacatttcattggactcattagtattatgtatttaaatttaaatttaacattgatcaatagcaataaattatatacaacacacacacatatacacaacatattattttattcacagaaggcaggtcatttataaataaacttttgcatagtctaaaactcatatattgatttatgctaccaaaatacagcctgggtaagcagagaaacaaataaaccaaatagacaaatatatataaaataggctgttttagagataacacaggacagattttattaactaatttatgacttacagtctgttggcagaagccttccttctccctaatttcagtctttctgaacaggaaaaacagaccagaaggcttgatggtgtgcaaagctcacatctttatctctgcaagagctttatttgggggtctggaaacagaaattctcaccatttttcattgattgtaatgtttgatatgttttctctttgctgggaccttcactctggatcattctgccaggttccttcattatcttcaaactattggcaaatgatttattggcagtaactatattcatggacaaggtgaactcattttctggcttgacactgtagccctcccttccttctattgcactgtgactccaaaaacacccaggcttgcagcaattactactgcacatactaatcagaagtttctatgaagtgctcctgctttgaactcagcaaagccacagccaagtgggtccttatgaaatgaaaatggcagtccctttgggacatactattccgatttaaaatggacttttaaaaaattgcacttctgtcttgaaatccatttgtgctaacatgggtcatgtagaggaaaaattacgaaggcagggaaagtagtggaaagagaaaggtctttacatggctaggacttttttttttcagataacagcttccactccacttccatcctcatccctcccatacacccaaatcccaatctgggtgcatacagtaaaatcttaaatatgcacactgagaagcaagtgcaatctagttatctgaaagttcatacaaacgcttctcaatcttccacccaaacattacacaagtgaaatgacaaaatgggttgcctcccactctctcccacacgtttttctataggaacataagtgtttagataactgaataggatcttgatgggaaatttaagcttcttaagaattcagtgaaagataaatgtggttttattaatacatacatacgcccaaaccgtagacatacagttcagttctaaaataaagagacttacataatgtgtgccaagaacaaagggaaagacaaggaacaaggcaagaagatataaattttggtaatgacttagatcctataatgcaacacctgcacaaagggaagctaataccttgattccacaaggtttaacctcctcctccccctcacctgcccattccaaggttttcctaaccctatggctgcagctttcactgcctaatgactccccttaatgggagaatatttggaagccagaaaggaattcgctgaggtcactcaagggtagtggaattacacatgtcatataaaatgctcttgctaaattgatgctagaaaaacggaatggcaaaaccttcacccaaaccctactgggaacgtgaagttaatggagtgtgctcatctgttagtgcaaactctcgggttacaattttctaaatcctatagtcctcttagaaatgataagggatctcagctgagaaaagcaatgtagcttattcctatttgggatcccttaatccaggttgaggggagggggtaagggggttggaatgaaatagaaagaattcgccagacaactgaagttaatagctgtcctgtacattatcaacaaggagaaaacttcacttaggtaaacttacagagatcttggctgtcaagaccctcatatcccaccccaggaagttattgaaaatagctcttctccctccaggctttactgctgatgaatttgtgggttataatggtaactcacatgtagggcatttgaccatgtatgaagtgattttcattcacgtagacctcatttgattgttccaaaaattcttgaggtgagtgtttatgacctaatttttaaagatggggaagatgagattcagagaaacttagcatcacacagctactaaatggatgagctaagacttgaacccacaccatgactttccacctcaaagctcatgcatttttccactcaatcaggttactcccttccaccaaaccaggccaactttcattgtcccctacaccactatccttctagatatgtgaatcaaattcctgagagtctgtttttacacctagtccctcatgatctcccttgccccatgcatcatccactcctttcgatttcacctctctaaaatagaaatgaaatccatccacttctcttcatctctaccaccacgatattagtacaagcagatattatttttgctttccaaggctcctgtttggttcacctacgttgactctgatggccctccaatctgctctactattttgatgcaaaagtaatcatggtttttgtaattacttttaactgcaaaaaccgcgattacttttgcaacaacctaatattttccaggttgctgccaatgtgaacttttcaaaagaccaatgtcatcccttgctgaaaactccctcatagagtctggccatttcctacccctgaaaacacactgcctcaagtcctttctgtccagctctcagctcaagcaatcctttctcagggaaattttctctgcctttctctgtagcagatcagctacatcctcttagtacaatcacatggcaacatatacctccattttatagcttttattccaggtgaacctttactcatgtctgtgtgatatttcatcaatgtttgtctcctacacttgactgttatttacttgaatgcaggttccactttagccttagcacacaggatgatgcctggttcagagaaagcatttgacaaatattattgaacaaatgtaaagcttctctttcttctttttctctttttcctgccctctctccattcctctactctcatccttatccctttccttgtcccatcttcatgggactttgctctcttacttagtcttaattggaaagaaatccatgacaaagcagtaaatatggcaactacaaatgttgttctccctaaagtcatttgatttcaactaggagactcttgatgccttaaaagacaacaaaatcattctctaatgctgatgttttagtcattctcatgagatggggaagatacaccctatttcatgagttctctggggaaattctttcccagtttaacccagccgatattgggaggtatcttacatttgttgctgctcaggctgcagttgtgatataattgtcaatgcctgcccatgaactctcttgatcatagtagttcttactgttgtcagttcatttgagctacaggcattattttaaaacaagccttgcctgttaggagaagagaagttgcacacctggtaaaaccactcaaagaaaaaggaaggaggaaagattcctgctccccccgtcccccccaccccgcccaccagccagagagagagagagagagagagagattgagagagagatcctctcaaggctcaggtggtactggggcagaaagttgtccggacagatacccaggagactatggaccccaccaagcgcgctggttcttaatgcatttgtaggcatatgtttaaagtgttaaataattagctcactgagatgtgtagtgacttgatgggcattccttgggttatgaatggacaactgcattctcttgtaggcccatttgtggaaagaatatagtcttgatcatcaccttctagtagaaatgcagagaaagaagctctttatttaaaaatgctgcattttggcccaaagtatgtcggcacggtgcagaaaagcacagatacaacgactcagttgaaaagttaaggcttcttaaaagtttatctcacctatatcttccattttatttatgcacagggggagacatatgatttttaaataatcagtctaaataatagtcagccaataactctctgttagagagttatttctatctaaaagagaataactctctgttagagagttatttcaataaatttagcataaaatatttaaatgctaagaaaacattgtgttatagattaattggaagaattttttctttcttagcgttgaatcttataatcgatcatatatgagattcaataaaaataagtcagaagtagggagccatttgatctacgctttgataaagctgccctgcttcctcattacacaaacaccatatggcccccacttgccttagcaaagagtgaactcttgccaagatatgttagcgcatgggatacattctctccacatcttggacgccacatcagattaaatgttacattctgctggggtagggtgttggtggatggggaattagagaaagagactggggtctgagggtaatctaggggggcaagtggcttttaccaatgaatttgctagcccagctcctcccgccattgctggtgaaaaagatttcaagctgttaaattaataagtatgaagtgagtatttttttgctttataaaatacggtacttttgagaaaacaccttaaaagggggaaatctacattgagaagacgtagattgctagagaagaaagaagtctttagagcaagggtgtcaaacacaaaaacctacaagggacaaacaggtaacaccaataaacagaggacatggtgtaagacattagaaggtatatcatgcttcactgaaacacaaattttaaatcattgagtgggcaaaattacataagggccaccagtgtgcatctgcttctacttcttcaacccctgaattgtttacttgacgatgtgcctaacttatccccacccatttcagatccagccaatatttactgattggcctcatgcccagcattgtgccaggtacgttcacagacatgaccattttcaatactcataaccgtccaatgaagtgtgtatttatgtctccatcgatagatgaggaaattgaatccctgagaagtttaaaatgtcttggccaaacccaccattcattgctctggaagaaacttgggaaacactaccattcttttgtttcttaacattgagccaaggatatcagttcgagtaaacttgttatctgttctctggtagtttatatgctgttttgttcccccaaggcaatacatgatgagtgtgtcagtacagatataaataactgcacaattagatactcagggggagaaataattttggttaaaataatcaaggcctctgttgcagaacaatagctataaataattcagccttttctggctcaggctctttgaccaaaattccaattctgtcacgtgttaaaactcaaactgtcaatttgaggaggctctgcttaatttcatttttgtctcaagtttagacaagtgaagagcaactcacaagagagtgtgagtatactcaactcacacacagttagaaccattctttatgcagcttcagctattatgtaccatgcatttctgaaaatgctatattccccaaagcacagcaatccatttttattttcttttaaaataaaaataacattaaatgaaccattgacattaatatttatagtaactcaatgtctttgaaaggttcattcacagaagattcccttatatgtgattgcaagcaattaatttaaaaacggaaatgtacttttacatttaactagaagtcatagtcctgactatcacctcaccagctaacctttcctcaaatataaatatattttaaattggttttactaatgccctaggtacttggaaaatcctactggtgcaaactcattattaattcatagtccccaattctaagccttacaggtatgaccttagaagtaatggcagctgctcttgcctactttataagaattgttaccgaaacttgtacgctaataatttccagtgattacaagccattataaaagctctcaagttacctagtactatggaaatagctcttctccatgtggcaccccaggaatacttgacaaccccaaagagagtggttttgaaaattacattaacaaaatataaactggcatcatccaactctcagttatttatagatgctctgcagggagaatcaagtggtccttcctctataagcacaccaagtttattggcatctacctggcattatctgacatggagatcatctggtcagtgaaagcatgaatatcttgacgtatcagttacttgttcattgcccaccagtgttttgtggccaccagttgggaagctctgatttagagaacgattagcaaaagagtgagtgatcaagtaagtttgcagcaaatcatgtttcacatcttgcaccattcaggtaatgagatttctctttgcagaaatgctatccattgcatgaagacttggtttaaattcatctgtctcttatatacccatttttcctccagagtacttagcataggacttcaaaaggcactcaataaatatttgctgaatgaatgtaacaggaattaataatgcaaaaaatgtttttgaaagataatcgatgtcaaatggtaggcagaggaagccagagaaagttcaccagtgatagaaatgctgtgtacaaatttggtacagtgcccaagaaaaggatttgaatttaacaaataacctttaaagccaggttcttttatgtccatcgcccctggactaagccatattagtggtgggagaatcccagccaaacaaaccctgatagcagtttgagaaagggaagtataagcaataaccaaatgttagaaaggattccatgaagcactttgccatcagttgttcaggaaacttctaagaatagaatagcacacacacatacacacattatagaacacatcattaaattctttataaaataaagaggacaaactggataacatgtagagggccttaacactctcatgattgcatgagcccccaggcccaagttaatacagtgttggggtattttgactggtttgatcaatattctgggcctagattgtcaaaggcagtttcctaactttagcacatcatgacagagaaattgatgcaatctgcaccatatatggaggtaaactgatgaagctatgtgatccagaaataaccttccagggatcagctcaggccagccacagcctgatggcccatgtgccaagaggggttaacagctgggtatgtctgcaacccactcatcatttaccagtgctctgaggtccatccattgagaagctttgttttaaagaatgtttctcaaaatgatcagcctagaaatgagccatcaagtaagtttgcagcaaaccatacttcatatggtgcacactatacttctctcagggagtcaaaacacgtattaataaatgaacatattaaggctctgagaagacctatttcccattgtttgtttgtttttgtccagtattttccaacctcttttaaccagggcacctactaacatcttgcagatctacggaggctgccgattggttaaaccctccatgcaagcacgcagtactgtgacttgaaaagggtcaatgcaacaatataggtcctaactgtctttaattggaggattagttcagacactggaaaaactttaatctttaagaaggaatcctcctggaactttgttaatactaaagtgttaaataccataaacaatattattacccccaaacaggctgctgaggagccggggatgagtagattctagccgtgagactcccagtaatctgcagtaattcatatgccactggcaaggataattctaaacatgagatccaaaaaccctatgcatacaccgcccccttgccctccttaccccaggagacttatctgtctttctggttatatattcccttggctgttagtgtaattagtgtataataactatgtacatatcaactcacaggaaaaacggcagacgtgctggctgatttggcttggggccatctcatcagcagggtgagaaaacctggtattaaaccatctgttattaactgtatattctaaaacagtgttttgtgtctcctgggttgctgactcccatcgacagcaacagaatgtcaagactcatatttttctgagcagcactgaaaagataaactttaaaacatttgcattgtcccttctgttctgcggcttgtgctattaagaattttatttactaaagtgtctattgtattatacacggtgcttttctatgtttcattctcacagaggtgaacaagtttcatttaaactgtgtccttgcgaaagttatgctttctagagtcaaagatcctagagaaaattggccatagcttttgtccttatgactaggcagttgccaatgcctgtttgaaatcaatagtctcactagggaatggactatgacttgcattttttaaaaacgtggtcattttctcaaatctccttgtttgcactgattacttttctttaaattaacttaagcaattaatttcataatatcagaaatctgaaattgagtctttgtgccacttgttgcagtcagtagcacaaacctgctcccaaaactcaggataaagtctgtatatgacagaaaacaacagtattcctttgaaagacgagcagtcaaatcattcaacacaattatccaagttaattcaactcaaaaaaccacatcaccatgaaaaaataaaaataaatttttttacctgattccaaatcacttttgacagctataaaaaattgactttctttgcaaaagttttacctatgccccagaactcagctgaaacattttttttcctttcccagttgtctcttacaattggctgttcccaagtataattaaaatttccctgcaagtctgttaaacactttcacatttccatgtttaattacattcagattgagatttttgtacacatatagaatatagccagattttaactcaattgaccacaatacctttgacataaagcctttattcaccgttctcgccatatatataaatagacatacgctccttgtcaaaacgcaagagcgagtttctttacattgtctagaacaaagaggccagctcggcttctatttttcctcagtgtctcagaaggtgtcctttattacatatgcaggatgcaaggattttgctgctgcgtgaatgaaaaatgataccttcagactgcctttttagtgacaaattacgcttttgcagaatatcacactgcctgtggttttaaaaaccccatttagatttactatcacttccttggggactcagccttcctcacaaagcaccccaaggctaatttccactgttttagagtgtaacaaagatgagaaagtttgctcatcacgacagtatagaaacgcttgcctaggaaaaacactctctggaatgtctaaagtgctaaaaatcattgcctctgtggattttcggtgtgcaaaacaggcagaaaaagttgtctggaggtattcgcaaagcattgtatttgttcaggaaggagctgtggggttagaggctgagcaacgcctcttactttgcttcctgggtgagagcagacaggcgtgccacttagcagaagcaagcagagagagagtggtaagactcaccagcttccccatttttcccaggatgggggtttttgttcctcagttctgatctggaagagacaaacctgtaggtccttcaagcaggctgggctggggcaagtgccggctctttgcctcggatcagctgaatggctggggcgttcaggaagcttgctctgtccagctcggaatcactccccctctccagggtgtgtgcttacacgcctctcagtcagcgcaaaaatccgccaaactcaggtcagcctaacaggtttccttatataggtaaacatgaattgcattcctggtgaaagaagttaactaggaatcctggtaacctggttaactctatacacaccagaatggctcagagttgatcagcctgcgtaggggtttggttgcagtacaaagggatttgtgcaatttaattaaaatcatctttatcctggcagtctgtaaaattggcccttgtagtgtgactgtgagtcaacagttagtattttatatcatgggctgtgaccagcctcatattatctgaaggcattgtaggggaaaaaagtgtaacattttataagttgtctttcatgtttttaaaaccagggtaattgaacttgagattattttcaaagaagtgaatagaacatgtgacagaaagagaatgtgaataaacctccatcaaataaggctcaaatccttatttgagcatagtaacgaatagttattcaactttcccaggcctttggtagataatgcaatacaatcattttgcgttttctccctttacaatgcagtaattgctactgtattttttgatgggcaaaatgacagataatgacatctattccaataacaaccctcctaagcccacatgctgatgtgttatttgatggtttcaggaaagaaatctaagacttgcgaatttgcatacttgtatgtaaacatttttaaacaacttcctcgatttaagaagataagaaaatatatcttcaaaagaactctatagctcttccccttacattttatctactacttagtaaagtaataattttaaaaaattctagccaattccactgaagacaatatggagacttgagactttcctgtgtactagagatgaagattgtctgctaaaaaggacctatctcaaaatgaaacacttgtttttatttcatccatgggttgactgctccttgagtagtgacaaccttattaaaaacagctcaaggctgttttaggtctctgtttaggacaggcgagataatgaatcttctgatgccacctaagtgagcaccaacacaaaccaatgtcaaaaagtttctgccgagatgagtaaggaacaaaaattgcactgccaggaagggtaactatttttgaatagcaatttccactgggaaaaacttttgcatacaatttctcttcttatctctgcaggaacactgtgaagtgtgtagtatttcctcttcacaataataaagttggcttacagagataaagtgattggtccaaagtctcatgatcagtttttggcaaatccaaaaccccagataaagaatttaactccaatagcatttcccaaaatagaatcaactttaagagacagaagaacattaaaatggcaattttccattttcaaatataatttttaataatcatatgtccagagaatttaaatgcaatatacaaacttattaaaatactttttataaagtcataacttactgttaacatgactccctttaaatgtctccagaaagatcataaaatgagatagagagtgtatttttattgaatataaatttgggttataaaatattatgaaaatataacttggcaaatattgcacacatttttctgttcacagtactcacatctctattgtatcaagttaagattcatcctgattcctccactggaaggaatatcagtgttttctacttactgggttttcattaatcttaaatgaaactctgtaccatgctaggtaaatggctttcactaatatagtccatttatgatctgcactctttgtgtcctcataattcccactgaagtaagttctgtttatgtagaaactttagactttattaacaggttgttgcaagacaaagaatgcatttttttttcccagggcaggctaaacctctaaatgccttaagctggcctccaaatttgttcttacaattcttttttttttctttctctttttttttgagatggagtcttgctctgtcattcaggctggagtgcagtggcacgatctcggctcaccgccacctctgcctcctggggtcaagcaattctcctgcctcagcctcctgagtagctgggattacaggcccctgccacaacgcccagctactttttgtatttttagtagagatggagtttcaccatgttggccaggctggtctcaaactcctgacctcaggtgttcctcccgcctcggcctaccaaagtgctgggattataggcatgagccactgtgcctggcctgttcttacaattctaagcaaacaatcatttaggctttaaacacaaaatatcataggctataactgttgaattggaaggtcaaaatgaaatttggatctcaaagtagcatatttcagagaggaaatacaatcctctgctaaatccattttagaggcctcaagaaatggtttgggaaagtctggatcactgaagcagcatgaattcaacctaaccatagaggaccccagtgaaagagtacttacagctaaataattacaccatgccaaaaaatagcacttatgggaaactaaataaaatacaagacctatttgaaggggagaaaatatcattgtggtttgaagaaaacatcaggggatagagtttagaaattcctaatgatatataactaatgagtagttgagctacaatttaaaacacactgcatcagactccagaaagctcactatttctatgcaccctgagtgtaccacagtagccaaaaaagagcagatgacttagagtccaaagatatttcaattccagttccatctcttggatgtgtgaccttggatacataatgcttctgagcttcacctgccagtggaagtgaaaatggctcaacatattagatttctgaaagtacctaaggagatttcatttcaatcattcttcatatatctgttgacatttcttatggtccaggcattctgctacatcctaggagtaacgccataaagaagcttggcacgttccccaccctcatggagcttacagtcttacagaaaagactgtgtatatctatattatgggatgtgaaaatctaatgttttcctaaatttctcacaacacaagaatgtctaattgaagttccatataaatatagcaatattaataaatgaatgatgtccaagcaacagctttcactgtagttagtgcaagttactcttactaacctgaggtggaccttaccatgattagactgggtagacccgggctgagccaaatcagataaatactgggggaaagtaaaacttgatgcatcagccgtatcatgacaatgtccttttatctaacaactgaggaggacaattagatgcaacttgaaagcatcttgaagatgctcaggaagctggatggacaatggagtgatttttcttattcattctgcacataaagaagtgatggaaaagcataagaaaaatttcctaaatattgtaatcagttatcagatacccaatctattattaattcacttctgtgcaagaaacatttaattggtacatactatgaatgaggttctgtgaaggatagacacagaaaaagatacacggagataaagaatgatccctggctttaataaagctttctagaaaaaatgttccaatgttcagtagctgtatcagtcagaataaataaagatatgctctggtaacaagcaagctccaaatctcagtggcttaaaacaacaaaagtgaatctgtcgctcacgccgcatgtttacataggccaacagggagggcgcacctatccatagccactcaggaacccaggctgctgacacaggaaacagggatttggtgaattgtgttggattttcaaaactttaccccataagtgactgttaaacttccactagcctcttgttggccaaagcaattcctctggctctgcttaacttcaaagaaagagaggagaatcaagatacatgacaaatgtttacataacagctatgacaaatcagccagctgaacaagagtaacattttggctaagttaattttatttcaccaatttattcagtagcacctgtgtggaaagcactataaaagggccttacagttaatttgagtaccttactcttctgggacacttataatgtcaagagagagcaaggttctgcaaagtctagcccaaagtgggctgtccaggacatcctttctaaatattactatttccctcaagattccactggaaccactgataatctttgagtccacctttaggtctctgctcttagggaaattggatctaatcagtcatttctgaacttaaaatgccagtcattatgccataaggggtattgagtctgcctgcttaattgaccccttctattagtgacttgggtgatgaaataaaagacaagttgatttaatttgcagatggtgccaaattggataactaacatctcagaggattctattataattcaaaatgaccttgaagagtaggattaaaatgacattaagaaaggagcttatgttcaacagagataaatagaaggttggaattaaacgtatagaaaatatatgttagaagaaaataactatattgaggtaacattagcctgcaagttgaatataggctggcagtttagcacttttacttataaaggctcttgggatatatttaaaaatatggtggtcttaatcttgaatgcactggaaaataggcgcttctcagaatactgcttcattggggatccacattttaagaaataagaaatcagagcacattcagaagtgaaaaaaagaattttcctaaagactaagtgctctagatcaggggtcagcaaactttttctgcaaagggccagagagtaaatattttcaactttgccagccattgtgtctttgtttcaactactcaactctgctgttgtgatccaaagcacccataaacaatgcatacatgaacgggcatggctgtattccaataagactttatcaaactggacagctgacctgggccatactttgcagactcctgctctctacattatacaaagtgtctcagaatggtaagggactcaaactgactgaaactgcctagaaggcaggaaaggccttattttggccattttcctattgctcagattcctttaatattgtttccacacaggtgctagtgaataaagtagtgaattaaattaaattaaattaacaaaaaatgttaatacaccagtctccttattaaatattgcaaaagaattggaatatgtacttcttgaaaatgtcatggaaatacatccaaaatataatttaccatgtcaatttttcaaatatttctcaactatattgtctttttgggaaagatattaatgatgaaattaatataatagaacttagagaataattacagtaatgaaattaaagggaagaaaagtcacaatactagccaaggtcaataaagcaaatgtcgccttcattaaacataggtaaaaaagaaaacgaggaaaggttaggtcaattctgtaatgtcaccaagctagtggtgatggagaataaattaggacccaggttcctggtgttcacagtcctagattatgataaacccaaagtacctaggagctgggacaaagaagcacacaggaatgcaatgcctggagatattcgttagaaaagtgaggatgaatggagtaacaaacacaatatcatagcccgtacatggaagtcctgtggtgtgtcttttggattgcctcaaggaaagcccagcactgtatatgccatttctccttcccttccccaggtgttcccatagccttacattctccaatccaatctggtttgcagctaatcccatagcatctccctccttagataaaggccagaaagctgaagcatagttatgggtgagttggtccaaatgttcctgaatcttgattccgaccacttcttaccaccacctccaccccatcctagtccaagatagcatcggctcctgcctagacaagtttcttaacctcaactgtgttggaatggatcattctctgttgtggaggttgctgtcctgtgcattgtagtatgtttagcagcatccctggtctctacccactagatgacaatccaattgcacccccacccaaagtcaagacaaccaaaagttatcttcagacattgcccagtgtcccctagtggtcaaaattgactctgagtgagaacttctgaactagattgttacaatagctttttaattgtcttccctacttctgcttttgcccctctacaatctattcttcacggagctgccaaagtcacctttaaaaactatttatcatgtgacacacacacacacacacacacacacacacacaccatggaatactactcagccataaaaaggaaagaaataatggcattcacagcaacctggatggagttggagactattattctaagtgaagtaactcaggaatggaaaaccagacatcgtatgttctcactcataagtgggagctaagctatgaggacacaaaggcataagaatgatacaatgtactctggggactcggtggggaagggtgggaggaaaagtgagagataaaagagtacacattgagtacagtgtacacttcttgggtgatgggtgcaccacaatctcagaaatcaccactaaagaactcattcatgtaaccaaacaccacctgttccccaaaaacctattgaaataaaaataaataaataaatatttattagatcatgctacttctttgcttaaaaccttgagtggcatcctcctacaattagaatgtaatctagttttcttaccattgcccagagagctccccataatctgacctctgccagcccctccaaactaatctgatagcactgtgcccagccaccgccttccttctctttctccaacatacccattttgttcagacctcaggacctttgcacatgcccttcccactgcttgaaatgctctccctggtgtggtaggtagaatcattacctcccaaagttgtccatattctaatcactggaccctgtgaatatgtaatgttacatggcaatggtaaattaaggttgtagatggaattaaggttgctaaaaaactgacctcataagaagattatactggattatctgtgggggctcaatgtcatcacaaggttgttataatgtggaagtggtggggagggggcagaagaatcagtttcagagtgatgtgatatgagaaagactgcagcaaacatttcgggctttgaagatagaggaaggggccatgatctaaggaatgtggacagcctttagaaactggtaaatgaaagggatcagaatctctcctggaacctccagaaaaaacatatccctgctgacagcttgattttagctcagttaggcttgtgttagacttcgacccccaaaagagtaagaaaataaattgggcctgttttaggccaccaagtttgtgacaatttgttacagcagccatagaaaacgaatatacctgccgtcttcactgctagtgcctcagtcctcagagtttatgcaaacgtcttctctggtaggaggctgcccatggcagccatgactgacattgctgtcctcgccatccatcccacctgcagtagttccacgtcactttacccatttcacttccttcatagctcttatcactatctggcactaacagagttcattcattgccaaacaaaaacaaaaccaaacagccaaatttcacctggatgaaaagtagaaaacaatgacaaacttgaaaaacaaaacaaatgtggcagtcattttatatgccttggatcaggaatgctggagaaagaaccaggtttggattaagtaaagaacatttatgttggatgaaaagaaatttttgacggtagttggagtaattgcacaatgaaacaggctgccaaggagggccacggaggcctagattgtggcaacactcacaagagagattagataactcaagtcaggagaataagtggagcccagcctacagcatttacttgatgacctgcttgttctttctccagcttgaaaatgtatgtagcacaaagcaatgaatcacaggacaacatctgcatgtaattgcatttctgttccaataataaatgtttcaactgctatgctatttacgaaagctgttatcataaagagccaagtgggggaaattcgaaacacaaatgcttatcttaagaaacctttcctttgcaattcagtgtgcaagtacccaaactccaaatttgctttagtatctgaattgtcctgaggagtttatttttgaaattctattttatagtgatttttaggtgtttgattccttgcaaaagctcttcacgtcacagttttcttaatatcttttgaacccaaagaggagcaaaggccagaaattgttcatatttccttcacagatctattatctgtattttggactcattgtcagccttggagagaaggtattttgtacctttttagggaagaatgttagttctcaaaacaaaagactagcattacagattttccccctttctccacaaaaaaggcaaaatctccaaaaagggatttttggcctttaattactagcaaagtgccaacatagtttaaaataattaacaataatgtagaagaaataggaagtaaaagaaattcttattccctcaggtcagccttgtttccctcatctccctgcagtggccaatacgttttctgtatgagtggcacaagaaaggctgacttacctgcacaacattctcaaagccaccagtgccatcgacacaggctagcaattattttggccttttacacttagctttgagtgaatgcacattttgcaaaataaagcaagctgaatttttaaacagttcactttactttgcatctttgaattgtgtctttcagcaatgtaaaactcactgctttgggtaaagcatgaaaactcatcaagatacagagaaaataaaacaaatctcctaaatggctgcctctttccatttggctaggccaaatggcctaagatgatgtcgctgagcgtttcttatttaatgagatggcaaataaccacgtggtcaaaaaatcttcaaagagcaatgaaaatgagcaattttccaataataattccaaagcaacaccccatttcccaaggtctgtaattcttaactcttatatgcttacttctcacttcattagcactgtttaaaacatcagagttgaatatcaaaaccaaatgaaaacttagaatggtcttttaggaagatgaaaatatatcgcagttttccaaagttattttcaatgaactttttaaaggccaaattgataacagtggttggactctcaaatggtttagcatctaggcagcctacaatttctgtttgccactcacggactctgcttgatccatggtatagatgaggatggagacagatatagagatattcattcaacaaataatactgggtaaattctatgtgtcagagacacattcatatattaaagtagataaaagcagcttacttaaaggttgaaagagtttcaaatttatgttttagtgaaacatagaaaacattccactttctcgtttttctttttttttttttttttttggttgagacaagctccaactgtgttacccacactggtgtgagtgcagtggtaacgatcacggcttactgcagccttgacctcccagactcaagggatcatcccacctcagcctctttagtagctggggatacagttgtgtcctaataccccctgctaatttttgtactttcggtagagatggggttttgccatgttgcccaggctggtcttgaactcctgagctcaagcgatctgcctgcgctgccttcccaaagtgctaggattacagcgtgaaccactgcgcccagcctcattttaaaattaaaaacaatgtgcatttagtgatactaaaaaacaagaacacatcaccagtgataagtgatgtttgtagcatacacccttgttagatgcgatgagaaaggcccttcactgccagtttttttttctctcaaacccataccctcagtttaatcatgtgaaaacaacagattaacctacattggagggaaattctacaaaatacctgactagtcctcctcaaaactgtcaaagtcttgaaaatgaaaagaagaccaagaaactgtcacatttcagggggagcctaaggagacatggtaactaaatgcaatgtggtagctttgatgagatcttggaacagaaaaaggacatttgtgtgctgggcacggtggctcatgtctataatcccagcacttcatctccacaaaaaatacaaaaagtagctgggcatggtggcatatgcctatagtcccagctactggagaggctgcggtgggagaatgccttgagcccagtaggtagaggctgcagtgagctgtgattgtgctactgcactccagcctgggagacaaagtgacactttgtctcacacacacacacacacaaagaaagaaaagaaaagaaagaaagaaagaaagaaagaaagaaagaaagaaagaaagaaagaaagaaagaaagaaagagggcatttgtggaaaaactggagaaatccaaataaagtctggagtttttaatgtaatgtattgaagttctatcttaatgtgaccaatgtaccacataatgtaagttaagggtagtcaattgaaggtatacaggatctctctgcattctctttgtaactttttcattaacctaaagttattcaaaaattaaaaggttatttaaaaaaaaacacacaagaacaaccaaacagtataccaagttagttttaccttgtggcaacagaaagaaaaataagatggagaaaagatacattgaaagcaaggacagaggcacagagacagagacctgcaaagaggaacagacagatacagaaatagactggaggtttccaggaaggtgttaagagctcaatggccttgttatgtgactctgctattatctcaggctatagaaatcagagaaaaggatgattctgtaaaagaaatgagaaacttgacataggttggaaacatacactagagtatagaaacttttctgcctttttctattttaaaatgttaggtattttttttctatgtgattcggaagggtttgcacatgtgtaaatgaacagctctgggttagcaagtttttcaggagcctttgcaaagactgaccaccaagcttttgacactgaaagctgtcatgcgctatggagttgttatttgagaaacccataccgtctagcgtcccaatgccagaaggacacatttagaattggccttgatttcttcctaatagacacttctgtttagaaatcaacctagtttttggtctaccttggaatagatataatgggaagcaaattaaaaaattgtttaaaaaatctgtaaggtttagtttaagttttcacagtggtacatataaaatcttcagagggtctcctcttaaaaggagtcccagtatttcacagaagattccctgatcattgaaccccacggttaactgcaattaacatatgctaggcgtttctgcagactagtgtgtactcacttacattttctatggtgttttcgaaaaaggaacttgaaacactattaactatatatcaggatagtctagacaaggttaagtgtgaggtattaacagtcaatcaaaggtatttgattagtgtgtgccctaagtcagtccaaatatgtacttcatggatggaatacttatacccaggcctcaaaatcttttattgatatttatcacagaatccacatactatattacatgaaagaaatctctatttagaaactgattgagattttaataatggttgttgggttggaattgggagagtagggagatagatctgggagacatctcagggggatgcatatttcctcttgaatgagtttcatatcttaaatgtgaagttctcatgagcttgtatttaaactttaatgtggcaaattacataaactctttaataagagccaaaggtctaaagtgccctcttagatttgttttctttttccactgaaacagcataccaaatctgaatctgattaagcctgctgaatttgttatcagtgctaggaactatgtattctgttcagaaaattaacttcacctagaaatgcatgttttggtggttttacactccccccaccgaccccaataaaagcaggctggttagaaaggcaataaatcctgggagaagccgaacttcatttttcctgataaagaattgggtttgcacataggctgaaaacagggctgaaattctgagttttgaagacacataatgactttaggttaagttaagctgtcaatgagggatgccctggttattttctccctatcacagtgtttgacacttagaccatatctagctttatttttatgcatctatgtatctatccatgtatatctatcatttaactatctcaaattttcccaacctcagcactactgaccttttagataattctttgttttgtgtgtgtgtgtgtgcgtgagggggtgggggctgccctgtgtaccgtaggatgctaagcagcatccctgggctctcactactacccactagatgctggtagcattcattacctatggtagtatatataataataaactataataatatgtaataaatacatattctctaggggagaatatgccttctacctattatccttggtggcaaccaactttttctgtgaacactgctttcagatactgcttagaatatgtcataaattaacagacaacatttaattgttttactgaattaagttagtaaatccatagcagatcataataatctcaaaactaaagcttgtttgatatataagaactaggattttttgagggagaaatgggattttcttgaatttaaaacgtttttctttaaatatcaacagtcagagccccagatgatttagaaattttaaaaaatggaccaacaagatttggtttctgaaagcaaagagagttgtgctgtacgtcccatatggaagactgggaagagatagctttgtgggatgccctgcccctatagggggcagccagagcagagcagaaatgaagaaaaggtcttagctggctggctccaagttttccttggctactccttgatgagaaggcagttggaggtgttcatgtgtcaccataagtggtgtggatagagtggttggaacttgagagctgggaacctgctaaaaggtgtgtgtagtgttactctagacaaagggtcccatcccagaggctgctatgagtgggacatttcagtctggggctagtgaaaggatgaggctgaattgcagggcctgggtgggaaacaaattagcagggatgaagatcaagtgtgttgtctagtccacctctacccatgttttgccaatgaaatagccttccctcactgcctccccacactcagaccacccttcctaggataactgcagaggtcagtagatgagaaattctcaagttggctggatttaagctctgaatgaaccacactttgaaccagaagtgacctttttcattgaattaacaaacaattcttatgctaagtggaaacagtggcttcaattgagtttagttatagagaaataatgtatttttgcaccttaatgatgtgactataagttttaaacttcctacaagtatagaacttattaaaatagctaagtccaaaaatgttgaagaatagcatattcaaaagatgactcacatttgtatagttatatcctcagcacccaaaagagtacttggcacactggaagttttcaaaacattttgtttaatgaaggcacaaatactaaggagaggccattgagagcagttagtaaaagtgtagattccagaaccagataacctgtctttaaattttctctccaccactaattttatgatttggagcaagtcactcaatgcttctgagccttagtttcttcacttgtaagaagaagggaatcatgcctgtctctaggataactatggggatgaaataaaaaactatatataagatgttcatcccagtggcttgcacacagtaggtcctcaatcatcatctaaagtaaatcatggcaggtttttaagaacacgtaactggtatcatttcaatctaaactttaattttaagcaaaaccataatgagcacaacttgggtcactttcttagaatcaaaatctgtgggtttatattttcatgatgtatcagatccctctataccacaactgccatgtcatgagtagaacatagacattagactcagaagttgacaaatgacccttggcaggccattaaaacttgttaaggctcttgattccatcatcttgtgaaaagggaaggatattaatttttacttcttagatttttttctaacgatgaaatgagttcaggtggagcaagtgccttataataaacttttgttaggcatttgttttaatgcccctgaagactggcttccatggccaattgcttcaaattcagcagcaaaatttatttcttcctgtgcttgactcaagagcatatatgtgaaagtctgttgacaagagtaaaacgttatagcaatggaggtggcagtgtgtaccctatcccttccaggtaattcttctaccctgtctctcttcaaacagaagctaggtatgcttgaaaatattgaactcccttttaacaccagcaattatttaagggcccccaggccccctactctcaggaggaagacagagtagagaccagcatcagcctaaagtcaggattgaacagtccgtcagagctgcctttgttgaccttgccttatggagttttgtctaactccgtaaacttggtttacttgactattccatcttgtgttgggtgacctctatgaacctgatccctggtttaagtgacctccacggcctcatttgctcactttctcattcactcactcattccttcagtgatgaactatattcaaattgtagttaatcagtgatactgagtcttgtggaagatcaaaggatgattcaggaattcactgtgcctttatacatctcagagcctgaaggggaaggaagaaaataattacacacagataactaatgctacaaatgtattacatttatatgcctgctcatactactaatatttaattatatatatgtatgtgtggtgtacaagtgtatatatgtaatacagatgataaatgacataagaagaatccaacttagatgtttttagaatttgatgaaaaaagatgacagataaggggcttatgcaaatctttgttgaagggcatgtgaggtggtttttcggcacagatatatttgggtgtaaggagagagtgccaattcagttattcattttataaaaatttgttaaactgcacatatatgcttaacttaaaataatgttgacagacactttaatcatcatgtttcttaagtttgcactacattgtctgctcctctgaccattccaaaatgtggtatctgaaatatatattttaattaggctaacaaaattattttgtcaaaccgcttctaacaataattgggatgtactgatgaaatggaaaaccgggattgggattcatccatctaagtcatctaagaccccaaaactaagataattttctcagagaaatagaatctatagctctctctctgcgttctttgactcactcagtatttttcttttaacacatggataatattgtttgtctccctgaactgtgtggctattatgggagtttttagggtaatttgtttaaatactttaatgagcccagtgtatttgaaatcatttcagaaggtctttcttccatgggcaggctgaccaagggttcagagaccagttcctccatcacagcataagggaccttagcagaatctaccaatgggtggaaggtgaactcctcacccacagtcccttgagggaaattcacaactagattggtgaatgactgaatggcttgtagggctagggatggttgtgagaaggacagagaaggagaggtagagtgaaatatagaagaaaggaagtccaggcaccaagtggggaaaatgtttcattgacaagcaaccttggaaagtaagagattaggaatcagggacttacgggttaagcctaaatgtggggatttgtatattctagctatgtttcaaaatcaatttataataactgacacaaactaaacagaaccattaaaataaggataaaagagtaagaacaacataataaaccaagagaagcagttgcttagaaaacaagtacagcaaagtcattagaactgaacacaatgattagctccaggagccatgggaactaaggcaggaagaaaaacaagactaattacatagtttgcatgatacagagaaagaggaaaccattttactagcaccaagagatagatattttagccaggcacgatggtccacgtctgtagtcctagctactcgggaggctgaggtggaaggatcattgaacccaaggcttcaagtccaagttgggtaatatagtgagaccctgtctttaaaaaaaaaataaaaatataggtattttattcaaggggtcatgtggtaggcagaagaatgccttcccccttccccaaagatgtcctaatcaccagatctgtgaatgttcctcacttgacaaaagggactttgcaaatattatcaaggtaaggatctcgagatggagagatgatcttaaattatcatggtgggcccagtgtaatcacaagagcctttgtatgggaaagaaataggcaggagggtcagagtcagagaaggagacgtgatgatagaagcagatgattgctggaaggggatcatgagccaggcaaggtgggcagcctctaaaagctgagaaaggcaagcaaacagattcttccctagagcctccagaaagaatcagccctgctgaaaccttaattttagcctagtgagaaccattttcagaattctgacctccagaattatcaggcaataaatttatgttgttttaagccactagatttgtgatactttgttatagcagcaagagaaaacaaatatagatctggtttataatagactgagaaaaaaatcactaaaatataacttagatcacttctgttgggactaaaaataatatggctgatttatgtaatattctggcaaggctgtctagatgtaagaatccaggtacatgagaatcatctgaagagatagtgaacaattcagatccccaagtccttctccagttctgctaaacagattctgtggctaggacccaggaatctggatttttaacaagcatgtgtaatagctattattgctgcatacaaattaccacaaatgtaatagcttgaaacacataaatttattatttcagtttctgtgggtcagaaatctaggcacaccttagctggttcctctgcttcaggatcttataaaggctacagtgaagtagccagttggggctagagtctcatctgaaggtttagctggggaaggatctcctactaagctcactcatgtcgttggtagaatttagttatttaagggcttttttcctctttttttttaatttttccataagttattggggtacaggtggtatttggttacatgagtaagttcttaagtgttgatttgtgagactttggtgcacccatcacctgagcagtatacactgcaccatatttgttgtcttttacccctcttatttcaacgcttttggactgagggcctaggttcctggctggctattggttggagactgtctttagttccttatcaggtgagtctctccaacatggtagcttgccttatcaaagccagcaagagagattctactagcaagatagggcatacaatcttagtaatgtaatcagggaagtgtattccattacctttgctatattctattggttagaagcaagttatagatcccattcacattcaaaggaatggattacacaatggcgagaacactaggaggaggagatcaatgggaatcattatctgggatgctgttaggttgcttctaattgacctaacagcatcccagatgatttttgtgtatgaccaagtagtgaagtactaacttagaagaataattaatagaaggaatcaacaattccagctgggtttttgacaggaaatggatttgaaacagttcaagactgtgggctctggtgatgtctctgctgtgtccttttcataacaaatgctgtaagttagcatagtgtctggaacttggagatagccattatcactactttcagtcccctctctgctaccagtcaattgctcactatccccaagctgacctcaacatctcaggggagctggtttgtgggaaaagtgggtaggaaagagggagggtaaactggcatggtaagagtgggtctctatggaattcatgagttctgattatttttagtttcttctcaaaaaatgtaaattttgccctatcacaatataaagagaatctatttcacaatttacacagctgattttaaatactatcctatttcaagctccatcacattttcctcagatattgaaatgttattctggcagaaacattggcatgtacttgccaagccctcctgggcacaacactaaacatttcccagccccttgcagttaagcgaggccagggaatggagtcagcttgtggcaagtggcctggctgctgaagcttccctcatggtctttgaaactctcttttcactcatccttggctggatgtttgagaacacagaaaaggcctctgaggcccttgtgatggcataggactaaaggagtctctggactgaaggagcctggggtcccaggcaactatgtggatttctcctccactcttgttggccaactgcacaggagtgaaatgtgagcaagaaatgaacaattgtgctgtgaagtcactgttcattacagcagctgacattaccctaagtaagagttgtattgttttcttctgcagaatggaagtcacgtgcttggtgtagagggacatgaaatagaatagttcataggggtgatgcatattccctttgtgttctttttctctaaattatacattagcatggatcattctagatgtcaattctctatctgtggaaattgagctatttctcagtgagtctgtatgacaggccaggcccactattctgactcagacactgattctaaggggatggcctgccctgaattgccacactcccaccaatctaaattgaaataatgaccacctgctgacaacctgtgccccaccccactagactagagagtctttgtcctgatgccagcctggtccaagcatagtttggttacgctttttagacatcctgtagtggaacgctggcttccacttgagagttcagggactactcagacattgtcttatttctacattaatacactaacctgtgccgttaaggtaccagcctgtcttttgcaaaaccccaacactttcgtttttaaaagggaaaaaatgtcatttaatatgtgtgaggccctgtgctcatcatacatcatgttttatgtacttttatttaaatgtctggggtaaggtatccggattatgttgacatgcgctgatgagaaaaatgaatctcagagtagtaagcttccacacagctaatatgtggagagaactggaattaggaggcaagtctaattccaaaggcaatactattaagttgtgtgtgcgtgtgtgtataatgaatagatttaaaaacatatagaaatatacatgtgcattgaacagtatttaaaccatgtatacatatgtatgtataatgaatagactttaagccataagtgcatgagagttgaagggaatttaaaccatatatatttatgtgtgtgctgtatgcatataataaatactgtcaacaatgtttatacatacttgtgtatgtgcatttaatagaatgtaaaccatatatgtatgtagatgtgtatgcattgaataggatttaaactttgtatttgtgtgcatgtgtgtgtgtataaggaacagttttcaaggaggatatattgacttggccaagcacacaaagccagtgacagaggtggaaacctattctggcttcacaaatctatgaaagttggccttctcgaagttctagatgttaacttctttcagggtagcttcttaataatttcagtacatatttgaaatgttttgcaaagggctagaaatatacaccttccacatcatgcaaatagaaaaagccaacagactgtataagatgaggttgtgctgtggtttataaaacaatattaataattatttctagaattcattataatgctgtatttgacatgtctgcttttaaaaaaatacatgccatctcatacaacaaattcagagtctgtgggatttatgcaatatgtacaataatattttaaagtacagttcttaaggttttttatatagttaaaaaatatctttaacttggcatgcatatatatatatatacatatatatatgaagctttggaatatcatcttctaaaccagctataaaaaatttggtaaaaataggacttaggcagaaaattttcttagctggtattcaattaatgttaacttatttactgaatgaacgaatgaacaaatgaatgaattactgatataagaatgcacattattaaacctgtatgataattaaggctatgaagcatataccatggattttctcgagtaaaactaaaacaagataaatcacacaacaccattttccacacatatgaggtgattgttaatttatacaatgtcacatcagttaactgatgataaaaatcttggcagtttggttgatattatgaattaaattctgtatgggtcatggttgcatatttcccagtttagggggtacaataatgaggtcttgacttgacttttaattttctaaacaacactttggttacatttctagaatttcgttatactgatgtcatatcacaagcccctcatgctcttggctatgtaacaggatttctcaaccttggcattattgacatttggagcgggatcattccttgctgagcagcatccctgacctctatccactagatgccagtagtctctgccttaattgtgacaactaaaaacgtctccattcattgccacgtgtcccctggggggcccaatcgcccctagtgtagaaccactagtgtagataatgcaggagcacatttgagagatcagggccttcagcaaggagctgtaacccacgatctggactccgttgcagctttcaacttttatctcggtgagattcaggatgttgactttccttttgattcttagttggctcttggcctcttctttagaaggtatcctgaaactaaccaacgacttcgtccaatttctccatccagtttaaattctggccacgtggctagaactgttttcctccatcagaataactaaagtttaaagttcaatgctccctaaactctcttgggatctagcagagttacttcaaaaagaatgtgctcttatataggctacttttaaaattatttagacaggaacagatattaaacttcatgcatttcactttgctgacatctgacagctattaaaaaataatctgacgagcatacatgtttacatgtgtcttctttctcaacagaatttctcaagtaaacaatctcttttatctatacttagatgaagttttaataatatttcattaagatctccataaaatttgcagcaatatttacgttttattttcattactataggaatcaatcatttttcctcaggaaaaattaggcttccacaaacaccctactgtttaagaaaagcagttaattacaaacactaaagattagtgtttcagcctagagttaaaatgaagaacctctcttatcctttgaaacaaatagagtctactcctgaatttgctaccaaaaatatattttcactgatgctccctgttagttaaatcatgtctgaaattccataaagtaaatgcattatgctgtaaatgggtagtcattatttaaacaaaggaatataagtaattatgcctctacacaaaaagaagagttctccaagtcactctcaagtgcttcctcaccgtgattcaagtttctgtaagttcctgtgtccaaattttcaaatgttgttgtcgacaaagtcctctcaacataacattctatgcttatctactcttggtaatttcctaataggtttatttggaaccaagatgtgttatttcaagcttcaaggtcttcaaacccagcatgagaaatctgggttggctcccatctgcctcttaattcttttctcttaataacaatccagtaatccaattttagcttgcattcaactcagtgctctatcaggaggtacggaattcagtttgctcatttgattcccaagtgccttggctaaaaatatgtcttgttattgtcaaagaaaacaatgcaatttgaagacttataaggaattaaaaggataagaaagaaaatgaggctctattaagtttaatatgtcatctctcagttttctttatttaaagggcaacagaatatgactgttttcaatacaaaacattgaaagtagaacttaaaacaactttcataaataaggaattttctcaggtgctccatggatgactctgaagggtacaggaatagcatgtgacacgactgagaggatgtgttgatcagcagttgacgcaaaagcttccttcttgccaccccaacttgcctgtgttattaagcctcacagctaaactatattagagggctggcaaatatttgttcctctctataaaaaattcttagcttagattgttggctcacgatattttaaccagaagaaatatctcgctttaaatcaagtgtcccaggtctcaatttaaaattggtgatgtactgagaacatttcctagggacagaactccactacatctgcctaccaggtggcagaaatgtaagtacccagagtaaattttatattagaaaggcagataattctgacacaagcagacagagagaaaagctgccaaaatagagcagggaagaaacaataccctaagagtgctcccctttttactgttccctagacgtgtctcgcccccgtcccaaattcttaaaagtcaccctacaattcagagctccaagctcagacttctcatgtttttgttgtggcttctgacctttcaactgccccactgataacctagcataagatagattaactaaccatatgctgaaaggttcgaccatcccttgggggatatcaaactacatggagaaactctatgtcctggcaggggaaacacagtctaacccatttttcttaccactgcatgcatttcacgggcctgggaaaaatggatattcttacttgttttaccaaactccatcaaaacaagactaggtgtcgcccaaacaactaatcagagcctggattttattgtggctcgaggggaaagcagaaagatcattgacattttcttggctctaaagctaccttaggggaaccttgcaacccagacgttcctcaagggataccaaatatcactgtacttgatgtggaaaagcatattaactcaagaacccagatattcttattcttgttttggaaaattgattgacaaatatgaagacagtcatatttgacataaatatcatggtacacttgttcttagtgccttcttaaagtttagtacaaaatattgagctaattctcaaagcctcccttctgatgccagaaaatatttctgcaagaattctatgcattgtcatcagcagagtgctgctgctcaatctgaagtcgttgcctgctggaataacctctcttccaaagctggagatctgtcttccaacaaaacaaacatccaacaccagaatggcaaagaaccacagtccttctctcaaagcctcttggtcaaggtgggaaatatttgagtgattattaacaaacacaagtggcattaccagtttcaatcacttcttttacttttcatctctattgccctctctttggttcaagctaccatcctgtcttccctacagtactacaacagcctctttgtttttgtttggtttttgttttggtaaaggttgttggggtgtgatttacatatcataaagtttaccccctctatgtgtacatttcaatgatttttagtaaattcactgacttatacaaccatcaccttaatccagttttagaacatttgcacaccttcaaagagatttctcatgtccatttacagttaatctccatttctcccttcctcaggctgcaagcagtcactaatctactttctgtctctctagatttgcctttttgggtatttcatataaatggaatcacataatatgccaccttttgtgactggctttttttcatgtaatataatgttttcaaggttcatccatgttacaacatgaatcagtacttcattcctctttatgcctgaataatactccattgtatggatggaccacattttatttaacaatttacccattgatggacatttggggttgttttcattttttggctattatgactaacgctggtgtgaacacacacatacaaatcttttctatgtttcactttaggattagaattgctgggtcatgtagatttatgtgtcacagtctctgaactcttctacttgtctcacatctgggcccacttcaagaccttctccttactatggctagaatggtctctttttttcttgctgaaatgtctttattcctaaagtatgatctttcatgtttctttttttaaaaattattttaatggccacataataattatatatatgtattggggtacagagtgatattttgatgcatgtgactgtcctgattttttcattacacattgtaaaatgatcttttgaaaactgaaattcacgtgttattttgcctggttaaaaatgctccaggggcttcccattgtcctcgagttgaaatcaaaactttgcaacactgtttgtggggccttgtatgatctgtttttattctgcagcctctaatcttattcctccacttcacctggctccttaaccttctctatgtcaatcagactaatctttagttttcagtacagactgtgctcttttaaggccttatcttgggctgttccctctatctagaaatctccttccctttagggtagtagttaaaagggaagctctggagttagacacctgaattcaccaattaaaagccatatgattttgggcaagtcatgtctctgtatgtcaaattccacatctttaaatcgaggattaataacacatcttgactcatagggtccttggaaggatgaaatgtgttacaatgagcaaagcgctttcaacagtcttcagtaaaagtcagcaatggccaatgaattcttcatttttttttttggcttagatttaactttcttctagaagctttcacagacctcttaagtatgggctagctcctttaagtgtttccataatactctgtttttgttgtatcatattgttattgccagtttacttatccgtgttctcctggtagtatctgagtttcgtaaggcaaaccagagtacctccaacttcagcatctaacagacagcatggctcacaataaatgctcattaaaatatttgctaaattgaaaaaaactgtattagatagtctctgtgttccattcattcccatccaccttcacccagttgtctctctcagagagacctacatggactgtatcatctagactacataccagctgtggtaagtagtttggttgggtttggccaagaggaagctctggcaagagacagatgagtgagcggaggaagaggtcatggtaattaccctttccacttcctccctgctgtggttctgccagtgactgcattctgctatagctatggctcctgttaagacatcccacttccagagctctagctctttctggtgccattacggacattcccttctcttgcccactcagacctaggagtggcagctgcagcttcccgttattgctaaccccattcctcatcagtcttttagccctgcccaaccatctgtaaaaagttcactattctctctccatgtaaactcatttgagtgtgccatctgctttcttttgagaccctgaataataacaatgactgagcataaccattcctgctaggggtctcaggtggcagagagtggggggactctttggtgtgttttgttggagagatagtggtggggtagaatatgatttcactattaaatagcttgcaatgtttacagttcttatttttatgtgtatatacgtcacttaccatatgccaggatgtgttattgccaatggtttccatatggatagttcataaagcattttactgctggatcattctttccggtgcactctgtagtgaagactgggtagcagtgcttgacttgattgatagaaaatcatagtccaccaagtgctaagtctcttcaagtatcacaattctttccagttccagctgatggtacatttcttaggctattatttctagttctatttgagaaacaatgctggatatgtgatctcacagttttcatttcaggaataggtttcagacagccaagcatcagactctgaaaccaggaaagacatataggttcaaagaccacctcctggatatccttgtctcttgtgttagtctgttgacgtatatcaagcacacactccttacagagcctgatcctatttgcttagtttccaagagacaggaggcttgaactgacccttcaggtgttttatgatataactattgctttgtgtcaaataggtgtctttttgcatatgaacttagagttataaacagcacacacaaggacttggcattattatccagtttgcataatttaaaatgattctttgattagtaaagctcagatttcaagagttctaactagattactttgcagccattaaaatttgtctggagctaaatgtgagaggctatactgaggaattgatgggttttttaaaagtacatattctaaaattatggttatatttgtttcctatagctgttgtaagaagttaccacaaatttagtgacttaaacaaagcaaatttattattttatatttatggaggtcacaagttcaaatggatgtcactgggctaaaatcaatatgtcagcagggctgtgctctttcaggaagtactaggggataatcagtttcctcggctcttccagctgcttgggcctgcccacattccttggctcatggccccttcctccatcttcaaagccagcaatgctggttgagtctttctcacactgcatcactttgacactgcttccatcctcatactgctgcctctgactatcttgtctccctctttcacttacaaggacccttttaattataccgtgcccacctgggtaatccagaataatttccccatctcaaaatccttaactaaatcacatcttcaaagtcctttttgccatgtaaagtaacataatcataagttccagagattaggatgagaggcctttatttgggcctactccaatctttgggggccattattctacctaccacacctattaaataattatttaaaaatttaaaaacctttgtctttgctgttataaataattaaaaatgatggaaataaaagctaaaaactaaaaagtattctatgggtgttttcaattttctcctgaggccataacaaaactgagaaacattctgttaccttgatgtctttaaatggaaataaacacaagcacttcaaaaggcttaaattttttgaacttaaaatggttaatacaggtaaaattactgaagtagagaatgtgctcaaaaatagtcctatattcattgcataccattttttaaatacatattattttccctaagttaaggaaaacgagtatttcagtagtaatgattataatggtttaggtttcagatgtcattttgtgatttggaaagctctatgaaataatttcatagttcatataatctcatcttcaaaattaataaagaagaaacacgttttttagcctatatataatttttacttaagtagctttgagtttggccctttacaagataggaactagaaaaatttttggtttctgtggtggaagctacgaattctccccctaattcacaagccaactatgatgtatgattattcatttcagcaactgagaagataattggaaagtttgaagacggccaagttgtacttcttagcaccataaagtgtcattgccatgccactgtactgaggacaatgaagtaaatggccagccaacaaaacttacagtaatcaaaaagataactacctgccaggtcaaggaacaggggtgacacagacagataaggcatctgcttttgtggtacttacattctaatggggaatgagagagaaataatacaccaataggaaggtgagccaatatacaaacaatgtaaatccagagaatgggaaatgttatggtaatagtgatatgctaggttgtgtctgtgccagaggggaggctactgtaagggaaaatgtctctggggaggggacatttgagctgtcttttgatgataaacagcacatcctgtaagtccttaagaacccaaatccctgatctccaaagtggagtatgtgcactaccaaaggcaagcaagataatctattggagtttagggaaaaaagatgagaacttctgtttgtatttatttttacttagaaaacaagaaagaaattaaactttgctaacaggggaggaaaagatttccatcactaggtttgtggccagttttctataacaaaaaactagattattaacaagaaaaaaacatagaaatttatttaatataagttttacataacacaggggccttcagaaatgaaggctcagaataggtaaacttgcatatttgtatatttaagattgatagagaatggacagtcatggagaaatatgattggaggacaaaaggatatgatctaatggtaataaactggggggaatttagcaagacttgtttgttcagatttttctctgcatccctgtgtcttcagataaaaggatgttcctttccttcaggtatagtttctttcctacagagaggaaacctctcgcactagggtcttacaacttgattcacgggagaacggtgaagggaagatgagagtgtcttccctgtttctgctgtttttccaaatgtcaaggtgccatattttggggtagtgtgtcctgaaccccatcactaatatttacatttttacattgaaaccctatatgtggcccgtgtatcagatagtcacccccactctgtagtattgcaatgtattgtactgttatattatctaattttaacttgaataaccctcacataatggaccaatggctttgaaatttttctataaggaagccacgggttgaggaagtactactattgcaatcttaagtcagtgataagaaaatgtcagaagcaactcttttcctactccaagtaggccatcatcagccacattatgactctttattcagagtcaaagataactcagccacaaataattaacgttatcaagaaattcacatacagcatgtattaacaactatttccattctatacaaactgtaccctaagagggaattgtgccttcccataggatgatgttatcacggtgagcagcacgtttcaaaatattatctatttacttcatgtttattctgttatgtatgttttataagacacaacatgtattggtttctggttcacgtatgtaatttataaatatatatatatttagaatacatgtgcatttattgttaacttctacacatgcataatcaaatacacttttcaatcgttgctctcaactatttgatagctacggctcttgtcaaagactgtcagcaactatatatagggcaacccatctctgaattctgaaactgattttcaaagatggtgtgaagttttcagaataattaaggtgccaagaatcacataatccaacagaatctaggtgaagtggcaatttcctggtgctttggaaggtacattctaattccaactagaagcttcaaggcatctgtgccaatccctgaggcaatgctgtaatttctgggtctttggttcatatatggtgagggtcaagatttctctgcatatttgtccccccagaatagagttccatgagtcgatacaggtcccatcatcagcaaattttttatgagcatgtgtgtatgtgtgcttgcatgcatgcacaaacatacaccaaagtgacaccaaccagtcttcccttgggctccttgtgatttcatcaaacacctttgaggtgttttgatatttgtcttattttaacattggataaactattctacataaaagtggttgttaactttctttggtctatagccaagaaaatctagaatgcttactatgaatatatttataattaggagttaaatgtattttaaagtatgtgcgtgtgttttactctaagtggcattgatgaaataattttcaattttgtttgtccttaagtataggccaattgaaaaagtacaattttcaaaattgttcaatgcagcaaattttcagctgctttcatgttatcaattgtctgtggtaaatagcaactggtaatatttaaggatttcctggtgactagattgggatgcatttctctttcccaggagaaaagggagccgcaaaggtgccttaaggtttccatgtcctatatctcacatttatcaaagtaataattgtcctatgaaaggatttttctcctgctccctttgtcccctcttcagctaggcacacacttccacttttaagaacacagactaactcatcccagaaacacgagcagggtagagttactgaagactcagccagtcatcagcattttcagagatttggtgcatttcattcccattgttcatctacatctataccatgccattctttgaagtgtaatgtcacataaagaattttaataaaagcatattgtataggcaaatatatgtgtgctcagataatggtgtccaatctttctgaggagacagataaatttataggagtgttctaaggaagtcactgcttcaggcatttatctgtagtggtgttggcgttggtaatggtgtgtatgcgtgtgtgtgtgtgtgtgtgtgtgtgtgtgtgtgtgtgtgtgcgcatgcatgttggcagaggttgaaggaataggctttcatagaaaaccatcttttccatactgtgggaaagaagataggttggaagccacttaaattactaatcaaatactacctgatggtccatacgaggcacatgaaacttatgaaagtggcttgaatgatccaagaaaactgtatatttggacctgattatttgttccctggaaaaatctcttctatccctttcttatttttaccaaatgccctaaaggtagattctggatcgaaggttcagggaatctatgagttccaaatctattttagtaaaaacatttccagttctgagcaactctgggatcagtgacaagctagcccctatctgggtgaggcagtcagtgcatagaggcacctggcagatttcatcagcagtgggaaggaaagggtgaggatggagcctcatgatcagtttggtctcttctttgttctctctagagacccacttaatcatttcaatctttccatatcaaggtcctagtaaatttttctttggagaggacaacttcccaggaagtttccaaagcctgatgtcctaaactaaaaacacagaaactcgagccccccacccacctcttatcatcacaataaacatgtaccacaataggatggtttaatttattttatatgtgtaagattttattacgtttaaagtagatgggtacacagttctttcatgcagctgtagtttatgatgagggtaacccaaaacacatgaccacatgataaaataatgtaatggagtgcttcaagaattctgagtggacagaaggttggaaagcaatcctttgtgtaaataagagctggtctcacataatggtagatgcttgtagatctaaaatccaaagaaacatgcactttcccctgggatgtcattttcagcataataaacatgattccaaatgcttttatacaaatattgtcacatgaaaagtctgaaggtctgtcatcctccaacaccatctatttggacaaaatttaaacctagaaatcattggaggggctgttttttatgaaggtaaattcaagaaagattccagcatttctcttcttgatcttgctgttaggtcatcgaccaactcacttccttctgatgttagcccaactggaggaaacttcttagataacttttgcaggtgtctcatgttcctgaagctcattgacttttttttttggctagtctagatgcacatcttcaggcccttcagacaggaaaaacatgcagcactgtcccctctatcacgaccagggacctgttccagcacttaggaaacctttgcagaatgttctttttttgctcacaagtataatcccctcacaatgcacaaaatactaagagataaaaataccattttggaaaatattttggatggcatgcacacgaatttaactaagcatgaaataatgtagtttactaggaagaggagatgctgttgagttaggaggcttgattcatggtcctcaccctgccattcaccagctggtgcaacttgggcaagtcacttgacctctgtaagcctcctgatcctcctaatcttaaaagggaccaagaatatctaccctacctactcacagggtacttgtaagaattggattacttgaattacttattgatatacaatgattgcatactgtgttgaagaaagagcaaagagttactgagttacttcttagggaatatttggtaaaaccagttcatttttctggaagagtgatctgaggcatagggaagagaagaactcaacatttctcatggttacacagtggatgtatgtttaagatacaaaacagtaacacaaacaattgtttggactgtgtactcactcagtataatattttccatgatatctatgtgaaaccggtttatagaacatgacaagagtattttttctccaaacctctgccttcaaacattttctgtctggctgccagtttcttctccaaagatatcccaggcagatccttccattgattgcttattttcaatttgaaattgaccagctcagtccattataaaacttcagtcccatattctgcttaggaggaactcctcctctgggctcccagtgctaggccttggcttgaggggttttagatagggagagggctttttccacttctttcacttgtcctcttccaggttctttctttttatttagtgtaagggcttagggagaaggaacagggttaggggtgcctgggggcagacaactctgataaaataggtacctttgtagtcaactctctgttgactattgctgctcttccccagaggccctgtgcatacataaacaaaacgcctgctctgtcctgcagctcatggaagtatttttccagaagtcccttgggatgggtctttccactacacagttctcaaacgtgaaagatgcacttcagtttgaccccacttcaaagactggctttggtggtggaccacacaacctcttgctgccagggacccctcacccaataggcagccatcatgggtggggcaatagcccaaacccaagtacattttcttcatgtccattggactcatgggaaacccaaacatcctggacacatttagagtgtgtgctcattggtctctgtcttcttctccctctccagtgattgtcctgcccccacatccagagaagaaacaagcaaatctgttacgtaagcaaatagctaactgtggaataacattccaccctccatcactgaaactttctcatcacttgacttaaaatgtaggtattctctgatgattctccagtgcatttctagacttctgcttgtaaaggttgaggaagttggtgaggagattgcagctgtgtgggacctcccaactctcaacaagttctgcagagtttgtgaatagagtgtgggaacacaagatgcctgttattttcaccctgttgtctttatctgctcaaatgtgctgttgagtcctgctggtgagttttttattttggttattgtacttttcaacctgagaatatctatttggcttttttccaataattcccatcctttcattaaatgttctctatttagtgagactttggttctttagatatggtttcttttaatgctttgaatatattcaaaatcacagattaaaagtcattgtctagtgaggctcaaatctgggcttcctcaggtacagacagtttctgctgactgcttcccatccccaaccccaccacaatgtatgggccacactttattatttctttgtgtgtccataattttttgttgaaaactagatatttgaaataatataacatgacaactctggaaatcagattctttcccttctctaggatttgttgttattgctacttgttgttttgttgttcgtttagtgactttcctgaactaattatgtacagtctgtattctttgtcatgcatgaacactaaagtctttgctcagattagcggtcagctaataactagacagatttttttaatgtctggaattaataagtcttccagtctttgctgaggggcattttgtgcatgttgggtcataccttcaacactcaacaaagcagcttacaacttggccttagcctttacttcctgcctgcacagagccccaagattagacagaggtgagaacttggtgccttcttaagtcttttttgagcatgttcacagccctgggtatgcacacagccttacacatgcgtgtagctgtccagattctcggaaatatgtcagagtctttcaaatctctctacgtacatctcattctctagctttttcttttaagtttttttggttagcctattatttgccctaactgttatctgagtgtaatctgagtgttctaggaataccaaagttcttgtaaggattgttctcttagccaaaaacttagcccaagacacaaacctttaggagatcgtagagatgactccaggtgaagagatcagatgggctgccatgccatagcattccagctcaccattcttcttcactgcctttgctttcattctggtggtaggggctactcctgtttacccatatctagacttcttctttcctggaattatgggaggacatacacttaaccaatccccttgccattggacagagggatgtgactagtaatggccaataggctgtgggcagaagtaacttgcatcatttcccaattgggaaactttattgccattgtgagacctcacagcactcttcccactgatgttatgaccagtgatgttccatatgttgttatttctattagcccaggtcccagaggcaagataacatagaataacatccttcatgggcatctgctatttatgaggcataatacaaaaataaacttcattgtgttatgtgactaagattttggtgttgactgttaatgcagcttaacctgcactaatctgacttgtctcatgattttaagcttggctcacctatggtcctctggtttgaccacctgcatcattttgatcacatacgtcacattcatcagcatctttgtgcttatttgatgcttagtgaagggaggcaaaagcctcatatttttttctctctctgagtctcacattaatatataaagctatgagcaaaccaaattttactatcattttctttctctctctctcaaaagaggtttatttgacatagactcaactagctaaaatttaacttataagaatatatacatactcagagttcctatgcctctttataacttgagcaaaccattgtcatcttgggtttccttttgctactccgtaaagcaaagacaagagtgatatttcccaaggtggctctgataatgtgtgtgttggggggttgggtataactaagaggatgttagggaaaatgttgtgtattttgcataaagttctggagtgaaaaaggcactccagaacttcccaagatggccaaataggaacagctccagtctgcagctccccacgtgattgacacagaggacgggtgatttctgcatttccaactgaggtacctggttcatctcattgggactggttggacagtgggtgcagcccatggagggcgaggtgaagcagggtggggtgtcgcctcacccgggaagctcaaggggtcaggggatttccctttcctagccaagggaagccgtgacagactacctggaaaaacgggacactcccacccacatactgtgcttttctcaaggtcttagcaactggcagacaaggtgattctctcccgtacctggctcagtggctcccacgcccatggagccttgctcactgctagcgcagcagtctgagatcaatctgtgagatggcagcctggctaggggaggggcatccgccattgctgaggcctgagtaggtaaacaaagcagccgggaagttcgaactgggcagagcccactgcagttcaaaaaaagcctactgcctctagactccacctctgtgggcagggcatagctgaacaaaaggccgcaacttctgcagacttaaacgtccctgtctgatagctctgaagagagcagtggttctcccagcatggtgcttgagatctgagaatggacagatctgagaatggacaaactgcctcctcaagtgggtccctaaaccccgtgtagcctaactgggagacacctcccagtaggggacgacagacacctcatataggcggctggccctctgggataaagcttccagaggaaggatcaggcagcaatatttgctgctttgcagcctccactggtgatacccaggcaaacagggtctggagtggaactccagtaaactccaacagacctgcagctgagggacctgactgttagaatgaaaactaacaaatgaaaaggaatagcatcaacatcaacaaaaaggtcatctacaccaaaaccccatctgtaggtcaccaacatcaaagaccaaaggtagataaaatcacaaagatgggaagaaaccagagcagaaaagctgaaaattctaaaaatcagagcacttcttctcctgcaaaggatcacagctcctcgccagcagtggaataaaactggacggagaatgactttgatgagttgacagaagtaggcttcagaaggtcagtaataacaaacttctctgagctaaaggaggatgttcgaaaccattgcaaggaagcgaaaaaccttgcaaaaagattagaggaatggctaactagaataaacagtatagagaagaccttaaatgacctgatggagctgaaaaccatggcaggagaacttcgtgaagcatgcacaagcttcaatagctgattccatcaagtagaagaaaggctatcagtgattgaagatcaaattaatgaaataaagtgataagacaaggttagagaaaacagagtaaagagaaatgaataaagcctccaagaaatatgggactatgtgaaaagaccaaatctacgtctgattggtgtacctgaaattgatggggagaatggaaccaaactggaaaacactcttcaggatattatccaggagaacttccccaacatagaaaggcaggccaacattcaaattcaggaaatacagagaacaccaaaaagatactcctcgagaagagcaaccccaagacacataattgtcagatttaccaaggttgaaatgaaggaaaaagtgttaagggcagccagagagaaaggtcgggttacccacaaagggaagcccatcagactaacagcggatctctcagcagaaaccctacaagccagaagagagtgggggccaatattcaacattcttaaagaaaagaattttcaacctagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaaaaaccggtaccagccactgcaaaaacaggccaaattgtaaagaccattgatgctatgaagaaactgcatcaattaatgggcaaaataaccaacggacatcataatgacaggataaaattcacacataacaatattaaccttaaatgtaaatgggctaaatgccccaattaaagacacagactggcaaactggacaaagaatcaagacccatcagtgtgctgtattccggagacccatttcacatgcagagacacacataggctcaaaataaaaggatggagcaagatctaccaagcaaatggaaagcacaaaaaacaggggttgcaatcctagtctctgataaaacagactttaaaccaacaaagatcaaaagagacaaagaaggacattacctaatggtaaaggaatcaattcgacaagaagagctaactatcctagatatatatgcacccaatacaggaacacccagattcataaagtaagtccctagagacctacaaagagactcagactcccacacaataataatgggagactttaacaccctactgtcaatattagacagatcaatgagacagaaggttaacaaggatatccacgacctgaactcagctccgcaaccagcagacctaatagacgtctgcagaactctccaccccaaatcaatagaatatacattcttctcagcaccacatcacacttattctaaaattgaccacataattggaaataaagcactcctcagcaaatgtaaaagtacagaaatcacaacaaactgtctctcagaccacagtgcaatcaaattagaactcaggattaagaaactcactcaaaaccgcccaactatatggaaactgaacaacctgctcttgaatgactactgggtaattaaggaaatgaaggcagaaataaagaagttctttgaaaccaatggtaacaaagacacaatgtaccagaatctctgggacacatttaaagcagtgtgtagagggaaatttatagcactaaatgcccacaagagaaagcaggaaagatctaaaattgacaccctaacatcacaatcaaaagaactagagaagcaagagcaaacacgttcaaaagctagcagaaggcaagaaataactaaaatcagagcagaactgaaagagatagagacacaaaaaatccttctaaaaatcaatgaatctaggagctgctttgttttaaaagatcaacaaaattgatagaccgctagcaagactaataaagaagaaaagagagaagaatcaaatagacacaataaaaaatgataaaggggatatcaccaccgatcccacagaaatacaaactaccaacagagaatactataaacacctctatgcaaataaactagaaaatctagaagaaatggataaattcctcgacacacacaccctcccaagactaaaccaggaagaggttgaatccctgaatagaccaataacaggctctgaaattgaggcaataattaatagcctaccaataaaaaaaatgtccaggaccagatggattcacagctgaattctaccagaggtacaaagagtcgctggtaccattctttctgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccaccacgatctggtcagcttcatccctgggacgcaaggctggttcaacatatgcaaatcaataaatttaatccggcatataaacagaaccaatgacaaaaaccacattattatctcaatagatgcagaaaaggcctttgacaaaattcaacagccgttcatgctaaaaactctcaataaactaggtattgacggaatgtttatctcaaaataataagagctatttatgacaaacccacagccaatatcacactgggcaaaaactggaagcactccctttgaaaaccggtacaagaaaggacgcccctctctcaggacagaaaaccaaacactgcatgttctcactcataggtgggaattgaacaatgagatgacttggacacagggtggggaacatcacacaccggggcctgttggggggtggggggctgggggagggatagcattaggagatatacctaatgtaaatgatgagttgatgggcacagcaaaccaacatggcacatatatacctatgtatcaaacctgcacgttgtgcacatgtaccctagaacttaaagtataattaaaaaaaaaaaaagaaaagaaaagcactccattcaaagtagtggtctggagaattatagacctttggaagatggtggaatctgttttctattttctgacatttattacatgctaaagctgtttggatgctcattctccattgagatatttggccccagcagcaggtactgaaacatggacttgctacacttatttactgatttaagaatagcagctaatccagtaaaaacaggataattcttatatcagcctgagatggtaataaaatattgtgtttctgcaaactctaaatgatttaatttttaacattttattattttgtttataaagcaatggccactttttattaacatagtaatatatttatgcaatgttacaataataattgctgtagttagaaaatttgtccctcccaaaactcatgttgaaacttaactctgaacatggcagtgttgataggtggggcttctaagagatgattgggttacaagggctctgccctcatgaatggattagttcattcatgaattaatggatttaagggttaactgattaataggtttttgtgggaatggggctggtggctttataagaagaggaagacaggcctgagctagcatgctcagtcactttgccatgtgactttataaacaatcaaatgtgtcctcttgaagtatgccttgggactctgcagagtccccaccagcaagaaggccctcaccagatgtggctactcaacctggaacttctcaacctccacaactgtaagaaataaattcctttttaaaaaaataaattacccagtttcaggtattttgttataagcaacagaaaatggactaagataataattaagcttataaaggatatgcagggataactacatttcatttcctctccaggcatccaggttctggtcctcccagaaggaatccttactaccattacacattatacgcatatacaagtataatatatgatacatacaatgtttaaaacctacccttcccatatttatcaacataaattggagagaatgtgcacagtattcttgaccttgctacttaaccttgatttttaaaacaatgttatcttggtcattgctcctctttagtctatacagacttatctattctttttaatggctaaataatatttcattgtacatttgggacctggcttatggtgcagatggccaagctggaaagctgtaggtgggtctggctcaaaattatagcatgcatgatacttattttgatagcacagttatgccgcattaacaaacaatccccagatgacagacatttgtgcttttttcagtctgaggcagacaatgccatgaagatcttgctctacctttgtatacatacatttgcgagtatatctagagaataggccgggcacagtggctcacgcctgtaaacccagcactttggaaggctgaggtgggtgtatcacttgaggtcaggagttcgagaccagtctggccaacagggtgaaacctcgtctctactcaaaatacaaaaaaaaaaaaaaaaaaaaaattagctgggcgtagtggcgcatgcctgtagtcgcagctactaggggggctgaggcaggaggatggcttgaacctgggaggcggaggttgtagtgagctgagatcacgccactgcactccagccttggtgacagagtgcgactccgtctcaaaaaataggtaaataaaaataaaataaaaataaagtcttagcaatcaagtgctgaaataaaaggtatgtatattttcatttactttgaataaactttatatacaatcaaatgcatcttctttaagtgtgcagtttgtgtatgtccatgttaccatcaacacaattcagatatagaatatttgtgttttaataggctttattattacttaggtatggtaaaggctgacagagcaggaaatgactgtcattcaaaagacagtttattatactcacagtttccaagagagggagtacacttcacactattggggagtcacctggggaatcactgagggtaaggtaacgaagccagtgggcaagagaaagaggaactgtgggcctaggcctttatcatggtttctgcaggaagcataagggaggagaaatgacctttggttgttagagaagtgaatgtagactctggattggttggtttgtatttaaagtgacttaggtatttcactgggttgtccagagcaaggtgtgttcggcatatgcatgcagggcagatgttaaagcatcacatttacagatggtagaaacatggttaatacaaattccattaacacagacgttccctcacagctgtttgcagaaaatccctccccaaaccctggctctaggcaaccacttacttgctttttatcaacatagttttgcttgttctagaattttacaagtgggatcatacagtgtgtgcacttttgtgcctggcttctgtttctcaggagagttttgaaattcattcatgttgttttgttatcaatagtttattttttattgctgagtagtattccattgtatgagtataccacgatttgttaatccattcatctttgatagacatttgaattctttcttgttgtgggctattacaaatattgctgctacaaatattcttgaaaatatctttcggggccacaggtgtacatttctcttaggcaaacacccaggtatgtaatttctgggtgtgtgtttaactttgtaataaactgccaaatggttttacaaagtgatcatgccattttatactcacagcagtgtacgagagttccagttgctccaaatcttttccaataaatgatatggtcagttgggatgtagattttgataaatattgtgctccaaatgtgtatcagatgcaatgttgttggttgtttaaaccaacatctgttcccaccccctttctttcttgcctctctgcattaagctaacacattctcagtctcccctgcatctataagcgttcaattatatcacagttccagacaggacggtataaaccaaagtctgctgggatctatctaggtaagcttttatttacctaatacaggaagagatgtgtcagcactactttctctctccctccttgctccttactgacttgaatgcagacatggttcctggtgctgtggtatgcgtcttgccacagtgagagggaaaggccaagagaaccacaagagataatggaagcactgagccaccaaaacagaagccacctacctttaaacttctaattatatgagaaaagtaaacctcaacttatttaagccattgtgccctaggtactctcttacttgcagaatatcggactaacattttttcatgtgtttatcattcataaagaatacaaaagggagtcaacagctggtacctctattgcatgtttttcatctttagtattttgttcttttaatatacatttacttaattatgactgaatttggaacttaatttgcttaaaagctattcattgtctttcctgttatatgcctgtatacatctttcggatattgattcataaaaattctttatatctcaataaactcagctcttcatctgtcatatttttcatttgtctctcaactttgtgtaggtaggttttttgctaatcagaaatttttagtttttatataacatgctttaaaatgagatgtcctatattcaaatgttgtttttgctctttactagttctgattcagggacttttctacactcagttatctatcattattatggtgggaaatccttcctagggttcttttgaggataaaatgagttaatacatacacgacattacattattttctgcatataatgagcatgcaaatatgagcttccactgttataatttacaattatgctatttacctcattattagggttcaagttgtttccttttatgttttttagagtttgagtcttgcttggaaatctgttttaactataaaattatgtttaaaaaatcatcttttgaaatatttcttttatgatttttaagaaaaattttgttgcagttaaagaacagagttgtaaatggcaaacagcaaaagagtaaagggtttttctttggatggtagactaagggatagatattaaaaatacttttatctgacatttttgtagatggttagaatagcatacaaagacacaagactctaggctttccagtgactgaagaacttgcttgggtagccgatgtgagtgcaaaaggtgttggaaaatatctgctgtttgattgataggttcttataaaatgaaatgaggtatatgtggtactgagttgagcatgggaaggaaagcatgccctggatatcttcccaggtagcaacaccctctaggaaccaaataggggaaaagcctaagacagatgatataattagagtattagcaactatttgcaaagtgctatgcttattattttgtaaatatgtattaagaggaaaggccagtgcaatcagattgttctggactcaagtcccagctactctacaccctgtgttagatgaccttgggggagctaactgccctcaataaacttcaatgttttttctattaaatgggataaacatgagttcctatgtcatcaggtgattgtgatgattgaacaagatcatgcagtgcacttagcacagcgactcttctagtacacactaagcacccaagaaatgttacctgtaattactatccagacaacaccattaggtaggtattatcaccctcattttgtggatgaggacagtgctgtccagagagcttaattagttttcccaagtttatccagctagtaagttatgctgggatttgaacccaggtctgtctgactccaaaccctacgatcttcctatttatcaaagtactttatgccttactgattatatgccttctcagttcattggtatgcacagtatttagatcatcttcctaagggaaatcatacctaaagtcacagagaagacactttcttcattttttctttgtgaaaatgtggctcccctacggcttcacctataggttataaacaggtatatggatcatccttctatgagaaatcatacctaaagcactaaaaaacaatggctttcttcagtttatggaaaggctctattcatatttccaatcttttctaaaaatgtggctcctctatgactccatctgtagtatacatacagatacgtggtaggtccaagttggtctcccaagatcaaattgtgtctcccttttggtggtctctactaaaacaatttgttttagtttatgaaatctttcaatgccattatcaattgagcttaaaatgttatcaaaaatttaaattattattaacacaaaaatctaagaactatggacaatctacttagtgtgggcttatctttccctcgatgcgtatataagggtgggaatttcacttttttaacctacattaaattagaattttacagtacatgccagacaaaaatcagcatttttctcaattctatttccattttagactgtaattttgcattggcttacattttaataaagttggcatttttacctcttccacatctggaacatttccaattggctttttcacattgtgaactgaaatagtaattcagttgcactgaatttgcttttaggaataaaccaccacttttgcatttctctcctttatgatttactgattttcaagatgtgccaggaaatacagaaatataggtatacatatattgtatacacgtatataggtactatatacgtgtatacatatattgtatacacgtatataggtactatatacgtgtatacatatattgtacacatgtatatatgtactatgtgtatacatatattgtatacatgtatatatgtactatatatgtgtatacatatattgtatacacgtatatatgtactatgtgtatacatatattgtatacacgtatatatgtactatgtgtatacatatattgtatacacgtatatatgtactatgtgtatacatatattgtatacacgtatatatgtactatgtgtatacatatattgtatacacgtatatatgtactatgcgtatacatatattgtatacacgtatatatgtactatgtgtatacatatattgtatacacgtatatatgtactatgtgtatacatatattgtatacacgtatatatgtactatgtgtatacatatatcgtatacacgtatatatgtactatgtgtatacatatattgtatacacgtatatatgtactatgtgtatacatatattgtatacacgtatatatgtactatgtgtatacatatattgtatacacgtatatatgtactaatatatgtgtatacatatattgtatacatgtatatatgtactatatatgtgtatacatatattgtatacatgtatatatgtactgtatatgtgtatacatatattgtataatgtatatatgtactatatatgtgtatacatatattgtatacatgtatatatgtactatatatgtgtatacatatattgtatacatgtatatatgtactatatatgtgtatacatatgcacaactgaagttaaaataaagcaagagttgcatgcatagttgaacttaatgttaatttgatttattcatatagagtagctctgaggagtgagaagctgaataaaagcaaatttaagagagagaacaaaatatatatatgtagattgttgagaacacaattgtttccatcccttcactgcttctggaaaataagtatgatttcaatttgttcaatatttaaatttaagaagaatatattctgttaaatcagtaactctggtaaatccactagataccctacatcaatgtgactcttaaatgtttgaaataatatgacaacaattcaagaagtctaaacggtcctacctttgaaaataaaggggaatgtaatttgcctgtcaagaatagccactccgccattttgtttgagggtgagagcatggtagggtaaacaaccattccatttgcttgggattggggaggttcccaagatgtgggcctttcagtgcccaggattttcctgggcaatccacaatgagttggctagcatacagcagggaaacctgtcgtgggtgttacaaattgcacccatctgggtttgatattggaacacgtgactgtccttcaagtgcccagaaccaagatcatccctgtaaatattcacagtgtctagatggaggaaaaaatcctgaaaccacaataaaatcttaaatgttttaaaaggctataatgaaggccttttgtagtttgatttctccagaatagtcaggatgttgatataaacaaaacatttcctaaaattcaattaaagaaaaccaactctccataagataagtgtcaagtctaaaatgaacatcaacttagtggtttgccatgagggaaagagatgtttatatatgctgaaaatgcaatattatgttaagaaggcaatttagaaagtagcttcttttattatcataagcattgagtcctctaagataataggatgcccattttacatgaaaaagtcaccagcggctaatattctagaggcaagttccaataaaactatacttgaatctgccactgttgcctacattcagctatgtccagaattggggaccatattgaaatgcatcttgtgtaaagcaaagacctctgaaaataagatatttatgctcacagataaaatattaagcgcttttaaaatgactagacacctctcttatctcttgtttacaattggccattgtgaacaagttctcaaccagaacattggttgaggaaagcgttctggttgagaacttttccatctacttttgagttgattacactgctagacaatatgcacagatgaaacacaagaggggcttggcctaactttctccttttcattctataagacaagtcagggtataaatcagatgtcagctgagtcatgctttcccttttgattgtcattaagttggttggtatctccatcccaattacagaggaggtcctccatggattcatggaggtaggtggggcttgggtttcttctagttgtttctgactcaaatttctgcttctgatgaattagattggtgtctcgatcacctcaccttactgagtttattgtctttggtgaccataggcttgtgccactcagatctccctttatgagaacttcctgccaggagtatggttagcagacaaccaccagctcttgtgcatacagctcccctgtggcatttatgccctgaggtcactcccagccaatgactgagcacagcagaggactagagacagacccctgtctgatgtggattcctctaatgggcaagctttgttcaggggctccccattagccaggccaagatgttcttggagctgcactacaggttaggagttttctgtcccaatattccttcctttcttctttcccctcacagatgtcagagttgcatcatggattaacgactctccctgacacctcctgcttatctttcattgacactttctccatctgcatatatgcttcttaccggagccaaactgacacatagttttttcttactgacctgtgtgtgctagacaccactcaaagtaccaatgacacaaagttctaggtatagcagtttttcatcgaaggttggaggcaaaggatagcgttcaccctgttatacaccaaatgatatgaaacttaatctttagcatctctgccttaaaatattttgctcatcccccaatcttggaatttctcatgaactgtctttccataggttcccacttcttgtcatgtctttcacattcccagctttgtatcatttctatgatctccattctgcactcaatatttgctgtgccccctagattcttgttaacatttaagccattgggatatcatctgccacagctcaagaagcctattatttatcttcctaaaactgtcaggccagggtaaaaaatgacattttttcaaaccctattgtgcattattaaggataaagaaccaaaagtctcacgtttacagatgaaaaagggacataatctccataactctatccaaccgggaagtatttcctcattctatgaagccataagaaaaaaaaaaaaaagaaacattaaattgggttaaaccaatggtattgtggtaataattttatacatttgattctggcattacatgaagatgaagcatttctctatttcttatgatcaacaaaattttaactcaatgtgcattctttcattcaacatttatttttaatgctacctgtgtgcccaatgcagaatttgtttttaaaacagtaaatcctttgtttgcaaatataatttcttatatttatttcttagacaccagtatatgtaagacaatgaaagacaccttacctcatttccataaatacttataaaaaatttgaaaaattgtgtgtttagggcaacactttttgtttgttggacatttggtccaatggtttccttaactctttcttattttctatgatttttaccatagacaaatgcttcttccattcaggcaggaagttggttgtgttttaaataaataaatgaatgcagacatatatgtgaccattttacaaatttatatgtttatttttttgcattttttgtgtatgtatgtatttccttctgaaagcacacttggccataattatgaaagaagtacattactggagaccacaatctctgtgttgaatattccttttgcaaacctttctgacctatgactcctggaaggaagaagcacagaacggcagtgatgctaggctgatacttctaatgatgcttgtctctctggtacttggaaggtaggatgcattgtgaaaaaacactcttcaacccgaatagtttgggctacaaaaagcagtagagtatgggatactgcccattttcagcaaatgaaatttggaaggaggatttcagaagtattctggacaacttgcccagtgcctcagtccagtgtttaaatgccagtggtgtttaaagtgagactgtttggaagtctaaaagcctcacattcaaatttcattgcaaagggagcattcttaagtcacatgcaaaaaatattatgtttcggttctgaattatctgtgtctaagcccctctacattccacagttaacaaaggttgaacagaagtaacatttctgcccttattctcctctcactgcattatttattatcacttgaagcaatatgatgctgctaatcctatgactgtacagcctgacttgtcccttgggaaatactcccagggctagagtctgctaaggctaggctagtcttaataatctacaattggcaagtcattcgtttgagatatcaaccaagatgagccaaaagacagcagagatttctgaccatcagtcagtaagaaagagaagagaatgctcaaagaaattctcaagaggaaaaatggctcaatgaatggccatggactcaagtcccataacctctccacatctcagtatcctcctttgtataatggtagagttacactggaaaattctggtgtccttttagctctaaaagtctacgaattgaagtatatgtatgtattttttgaatgacatcagtgctttatcaaactcgaaatctgacagagcatccttttttttttttgagacagagtctcgctctgttgcccaggctggagtgcagtgctatgatctctgcccactgcaacctctgcctcccaggagcgattctcctgcttcaggctcccgagtagctgggattacaggcacatgccaccatgcccggctaatttttgtatttttagtagagacggggtttcaccatgttggccaggctggtctcgaactcctgacctcgtgatctgcccccacctcccaaagtgctgagattaccggtgtgagccaccgtgctcggccctgacagagcatccttcaaaggtgcaccccttgtgttttgtttcactagtttcaccatgttaaaaaagaaaatatttcatttagaaaccaactagtaagcataaaatttaaaaacgtggtggaagttgtcagtagatatccatgtatgtgtcaaaaggtggtgaaagggattgtccaatttgttaacacctcattttttgatcagcccctccataaatacctttctcaaatctcagaaagaacaagaacagaatatacgtaagctgggcttattgaatgagtccaaagccttgtaggaagatataaagccttgaaaccacagattctcagtaagtgacacgcaaatgtattccaaccctgcagtctgccatttaaaggaagcagctcttattacatcctgggtttacttatttgtttgttttgttttgtttcaattttactgaagtttgatcacatctggcaaatgtctatacagcagaggggagagggaaagagatggaatgggaataagaaaataaacttgccataggaggagggggagttccagaaatattttctacacaagtttccataataagccaatggtaataaggtctcaccacatgccaggcactgggtgaggcctacaaggcaccatgctagatggacatcaaagagagagggatgaaacacagctacttggcagacgcatctgagttaaaaacccttttgcacgggcttgagagaggctgttgtcccctggagaggctttggcacggccagaagaaaacatcaaagacactccagacttcaaatcccctccaagggtgcgatcagcaggacaggaaatgggaaagtcattctagaagggatttggaagggaaggggcttatccacggatgcccctcaccctgcacatgagctctcaccatgtgtacagttaacagacatgatatggtgaacagcttggcacccagtcagtagcaagtcttactctagcccccgaccaagaagctgtggggtaaggcgacacaaggaaagataatgcaataaggatgttttgttgtcttcatggtcgacttaatagtttgaaaggatactatagaacagggaagcttgcattctaaaacaacagaagcacaaataaataaccaaagataaaagtccaaagaccaaagtcaaccaaaagaaaatgaacaaatagggtttgcctgaaataatatctggcatgctaaactaaaattcctggtaacccagcagggttgcttcatgcttatagtaccccaatatgaccaaggaaccaaaagttgccaacaaacacaaggaaaggcctttaattccatgtcactgggaaataatgacagactatgaaatctgtccatgtgcagagcccaaacaagactgaaatttcacatgcggcctgccattgaagtgggaccataaaaatgaagtcagccaagctgttttttttttttaaagacaaagagctcctacaaaaacaaggaatagaaacttctttgaagagataggaatgtgcaagcaaatgtatgggatactgtggatgtatattggttgattaaaccaaataacacacaccacatatgtacatatgcgtacacacacacacacacacacacacatttgaagttgagcaaagctgagatttttaaagtaaagctgcagcaagtgatatattttttaatgagttcccaagcctggtaatcttctctgccacatgcctagttagcgaggacccatgcatgcagcttgatagctgtgtagcataatggtcaagcttggagtttctggagtgaaaccttctggccttagatagcagcttcactaccaagtatcagtgtgacttagaaaaggtcctggaccagacctcagacaacatgggcataatagcagtacttaccatatatggctgttgtaggtataaagtgagataatacatgtaaagcactggactgaaccctaccacatattacggactcaacagatattcactattaatatcataaatttatcataagctctgtgccccatatccctttgtagtatgcacagcaactaacagagcaaagagtaaaaatagtatttattaaatacctgttgtttgatttacaaattaggaccctattgtttgtttgatttcctaagtcccacaatataattggtgacctataaaacaaaattgttttcttttcttttttcctatgtgtttattttcatcagttacttaaaaaaatttttttccactgtagtcagttttaaaaattcatcttcttagaacaaagtaaacacctgttccttgtcatcagtattaaatcccataaataatccttctggagcccagcacaatattagcaccttagaataatgttcctcacgatatctccaagaagcatattcttcacatgtccctatttttaaaaataccatattaaagttaatttaaaaatgctgaattaaacaatgttaatcaggcatgcaggacttaccagtcataaaagtgctaatgtgtgctgtggatctccaagagatgaatataaaatgaaatgctgtgttccaacaggttacttgtccacacaattcctttttcatggaattacctctctcacagagctataaccctcatacagcagtaatgctctgtggtaggcactttgggacattctatgttcaagggatgacctgaagtctactgattttatcctggaaagtgggggtcaccatctcatgagaacacagtcacttttctgctcaggtggtctgcatataaagcaatgatagctacaaaacatcagtatcctgatccccagggctgattctgatgattttactggatggaatggtgttttttttcacttgcactactccctgtgtaggttcctcctgcacctataagctcagaaatatcaaattcttaaaaagatgaatgtagtactggtttcggtcaagggcatcacttattctggctgtgcgttatgctgaacacatcatcagtggatactgcaagataacacaaccttcatttgtactgtgctttccatagtcatttaagcctgcattgcaatttagtttcttgattagcgtttcctaaactttaggatcataataatcaccagtggaacttgggaaaaatcatgattcttgagttccaccagccctgcagtctccagttgggaggtcatatgttttgaaatgctctcctagtgaggcttatgatcaagcatcttttggaaattcaaacttggctacatattacatgttttatttttttttccaaataccagaattctaaacaaaacccactgcatcagaatctccaaaggtggaatgggtatctgtatttttaaatgtctaagaaatcagtcagtctttgaggggagccacagctctataccatacgccagagatgtactgacagctagggatgaaattggaaaccagcttctccaatttgaagtctcaggtttcttttattggaccacttaatattggtcatgaggtactgaccagcatggcaccctaaacgggaggagcccaaatacatactgaacgagtaaggaaggaatgtcaaaagtaatacctgaaaataaatacttttctctgaaaataggctgagttgagagaagggaattcatccaaaatttccccatgtggtttggccaataggctcttcttgagaagatgtgatcattccactttaccttccagtattttctacagtggaaaacagctccataggttttcttcaggacatgagatacctccccaaacattatcaggcagttttctgactagtgatatgttttcccaatgtattttcatttctgttttgtccccccaaccatgagcctgaatatatatagaacaagctctccacggggagacatggcctcctgagtgggaaatgtgtgagccctgctgtaaaggaggagactcatcatcagctattagactctagaaacctcatgctagaaagaagaggcaatctcaacacagttacaaaactagctaatcatactgtcagccctgagaaactcttatttgaagaattagcacaaatggtagaaggaagtgaaaaagaattaaaagagaacttctggaactaattttgttaacatgattcctacaacaagacacccctcagggatcaagatgcaatttcttttgtaaaaaatttttttatatttccataggtttttggggaaacaggtggtgttaggttacatgagtaagttctttagtggtgatttgtgagattttggtgcacccatcacccaagcagtatacactgaacccaatttgttgtctcttatccctcacccccttaagacgcaatttctttttaacagttcatctttcctgggcgataaattttagacttacagaagagtttcaaagatagtacaaagagttctcatatatccttcatctagctttccctatccttcacatcttatataaccatcaaaattttattaaaactaagaaattgactttagcttaataccattttaaatggtattaataccatttaaataaatccaaagtacaggatttattcatatttcatcagtttccccactgatgaaaaagaaatcctgtcccttgagaggtttttaaatcaagacatgtcttttgttgttgttgttgcaggcatccagtgaggattccacattgcattaacttgtcacatttccttagtctcctctgttctgtgagtttctctttctttccttgtctttcaggactttgacacttttgaggagtactggttacttcttttgtagaatgtcgttcaatttgggtttgtctgatgttttctcatgatttagaatgaggtttcacatttggggaaataatactcctagatcacctagctaagctggtgtctgccagaattctctacaataaacttactattttctctttgtaattattaaatatgttgggagagatactatccaaacaaatatcctgttattgcctagactatcacccactcactttaacgttcattcgtggatttttcctgagacaattaccactatagtttactaattctatttttgaactactcaatttagaagttctattttttaatttccatcattctttttacttttattcattggaattattctgtaaggtacagttgttgtttctcctccatttaagacaaaatattgaaaggatagaaacagggtatataatttgaggtagactggtagaacagcatgcatagttgattggatcttcagaatatgatactggaccaccatccactgatagtattctactataaagacaagcaaaacatgcacagggctgggcacagttgctcacgcctgtaatcccagcaatatgatactagaccaccatccactgagagtattctactataaagacaagcaaaacatgcacagggctgggcacagttgctcacgcctgtaatcccagcactttgggaggccgaggcaggtggatcacttgaggtcagaatttcgagactagcgtgcccaacatggtgaaactgtgtctccactaaaaacaaaattagccaggcatcgtggcatgcagctgtaatcccagctacttgggaggctgaggcaggagaattgcttgaacccaggaggtggaggttgcagtgagctgagatcgtgcactgcactccagcctgggtgaaagagtgagactctgtctcaaagaaaaaaaaaatcaacaaaaaaaaccattcacagggcgtgaaaagttctggagtttccacctaaactccaggtttaggatgcagcagggtggagatgatgtgaggagggggttgttcctggtggtgtccatctgaagatgaagaagatgaaacactagccaggaacaaaagtatttctgaggttcagagagtataaaggcagaaaaggctgaacaggtgagtggcaattgatgcttggttatgaaaccagtcaatatcaaaagaatctaagcaaaaggtggcaggccagtgacaaaattccataaggaaaataggccaaaatcttatggggcttaagactgaacacagaggactttgtatgacagcagggaatccaggcaaacgtaatagacccagaaaacaaaaagatcagctggtatcatcagaattgttctctgtgaatggccagaaagaaaatgttttaggctttatagtctgtatagtctctgttcaacaactcaactctgctgctattacatgaacatgaccatatacattatgtaaaggaatggccatggcaaaatttgacttgcagtagtagccagagcacaatttgagcactgtataatttacctcttgatcagtcctgtctcaacttgaaaacttcccaaggggcagagaactaaaaaaatgactatagtcacttaaaatgaggcataacaattttacgaattcttgctaatgatagggtctttgagttactttagttattgtttttatctagacagaggggtaagcattactttggaacttaatcaagttagttatttatagtacgtttccccaaattagatacattacacacttttatttggtagttagagttcagaagtacattatgttgaagtttcttgaaatttttttgaaccaaaattgaatacaagtcactgttattattaaatgacctcttaacttgaaattttatgatatgagtaatttgaaccaagttcttgccttaaattatttcagtaagttgaaataaaggaaatgctaacattctctccatcctttgattcatctctggcctggtgttttgtttaatgttctccttaaacattatacctttgaaatataagcttttaaaacataatagtgactaaatagaggaggatgaaccaggggagaacttcaaatcatttcactctaggagggttaaaatatatagaaaatgttaaactaatccttttgggagtgagatatcaattccattttccttgtaccctctgggcttttcttgaatctttgaaatcctttccctataactggaatctctgtgaaaatatttctgtatatttattctcaagtagcataaaaacactttagaattctttgttaacttaattttatgatattttacaattttgacagccttggaacttaaatagacacaaatataatgcaagatagacaaaatgcatgaccattcatctgggagatgaataaaaagaaaaattacctttcaatattttcaatttccataatgttctattagttccctggaaatttaatttcaaacacatgtcacactttacagatttaatgtgaagtaaaggaataaatttcagtgaaatatcaaaaagatgttttcacattttaaatttcattagactgaatattggtataagacatacaggattcatgtcacaatctactattttgtaacattggaattgaaatattatgcaaattatttttcatctaagaatttttcagcaatttgcttttaccttgtgaaaaaaataatagtttcacacccccaaaccagtagacagactatagaatcacttgggttttagggctatagaaattccaattattatattcatgctttcctttgggtataaattaagtaggccatgggacagttttgtagaatgaccacagctttacaaaccttatggttcagcagatgtggttgtaagatatgggttcactgaaaaatattcaccactaagcaatttgaggactccattctgaggttttgatttaaaaaccaggaatttccagttgaaaatgggtagatttaccatcatattggtcttcagatacagaaatattcagttgtgtcacataagcaacaatgtgaatcaggagtatttcaaattgcaatatttttacaaatctgcaagtcatgagctgagaaaggtgttcagcacatgcaatgactcctatttcagtttctttttgttgacctcaagatattctggggcttttcttggtgtataaattagaagccttcatggaggcattcactttgaaagattacctcaatatttaagaaaattatttgaacagtgtattctctgattagtaaaatatgtgcattttcgagtaaatgtggtattattgaagtgttctaagattttagaggaaatatcatagctacaatcatttcctgggctgtggatttgaataacattatccatatgtacattgagaaatttcataaaatcctgaaatgcacaggaaccaagtaagtacctagacatccatgagaacagagacaatggagcttcagaaacacattagtcaaactcatgcttcaaaggtttgagttaataaaaaattgagtcagaccagcagtactactttcatctagatcaaaacttcccactctaattccttgactgtgagaggaaagtgtatttccagatttttctttgtaaaataaaagaaaatctgaaaaatgctgacatacttcctcaatggttttagaacttgtgaaactcattacgaaactcgttgagttacaatctaacatttccataaaacaggaaaggctgatgaaattaacatgctaaaaagttgcaagggaaacctacctctacaataaggcaggattgcagtactgatcctcaatgagtgctgtttctccacctgggggataattcctagttggtggaatagtggaatacttagtcctcagaaccttttttttttttgagatggagtctcgctctgttgcccaggctagagtgcagtggcgtgatctctgctcactgcaagctctgtctcctgggttcacgccattctcctgcctcagcctcccgagtagctgggactacaggtgcccgccaccatgcctggctaattttttgtatttttagtagaggcagggtttcactgtgttagccaggatggtctctatctcctgacctcttgatccgcccacttcggcctcccgaagtgctgggattacaggcgtaagccactgcgcccggcccctcagagccttttaagctgttccagtttctcacttactttcccatggaatattcagagtatcacttacggttttattagtcagaactctttggtttcccaatcacatgtccctgtttacttgtagtgtccttgaaaatgaccacacaaaacctcactgaagtcactcatatagataaatgaagaccaggaagaataaaagtactgtttcaattgcctatgaagttgtctgttttctctcactagattataatctctgtgagggtagggacattaagcatttatcctcagggtgtcatcaacactagtatggtagtttgtacataatataggagctcaataaactattttagtttgattgattacatctggggttattagcccctacacagtgtgtttcctctacttattatcaattaaacttcacagtgacttttccagttaggcaatattatcctaaattgctgaagttccaaggtaacatcataggaaagcaaaataactggcatgagaactcagggtttcttagtccagatttattatttccactccccatcagctgcctgagaaagtattcaatggacagtagtagtttcaaaatcttttctcattccacaaaataaaggataataactagatttttaaaaatataaatacctaatataagaatcctttcttgaccacagaaaaggaagggttttgaaatccattattcctttcaactttgaaggaacagaaaagtcttcagttaattatttagggaaaagacttcccaatccccaatccaatattttcctaatcacattcctagttggaacataggcactgagtttggaacctgaagcttatttcctgtctaaaattgttttcattcatcgtatgtgaacacttgttttttattgcaaagttgtttacaaagttgagctgccggaatacatttcttttaatgaacaaaagagtgatggaatatttagctggaaggaattcacagagctgcatgcaactcgaaaatcgttttaaggtttaaaagttgtaatgtaggctttctagtccaaagtggaggaatatagaggtaaaaaatttttaataaaagaattgaataactcagaaaaggaagtctgaccatctcttcaaactaaacagaacttgctttcatctaaaataatgtttcattcaataaacattaatgaatataaaatccttgctacatgccaggcatcaggatacaaagttcattaacattgatcctacccataacataaaagatcaataatttcatatcttcataaaaaatggcaaatgactttctaaaggcaattcatataagtgagagcaaatattcagaaccccagcaattagaacaataatatcaacacataaggctgagatcaactgcatatacaagccaccttgaagacaaaaacctggtacttggtctatagaatatgtgaatcaaaagagagtattcctttttttaatcggtgaaacttcagtctttttacttaaatcaagatataattcatgcaccataaaatttgccattttcaagtgaatgattcagtgccttttagtatacttacagagttgtgcaattgtcacaactatctaattcaattttcatcactttaattagaaactctgtaccctctaagctgtcattagctgttccctccttcccctagtccctgggaaccacacatctgctcttggtctctatggatttgtctattctggacatttcatatcaatgtaatcatacaatatgtagtcttttgtgatggactccttttacttagcataatgctttgagtttcatctatgttgtagcaggaatcagtacttcttccctctttatagttgaaaaatatgtcattgggtggatggactacattttaatcattcatcagttgatggacatctgcatcgtttatatttttggctattataaataatgttaatatgaacatttgtgtacaactttttgtgtgaacatgttcctttgataggattaacttagaaaaaagaaaagtaagagtgaaaaaggcagctaacactgtgccaaagacagcaaatggcctattataaatccacaaatcaggattctaatattccctaattattccgaagataagtcactatgtcctttgctacaggacatattcatgggccccaaaccaggcatactaaatttgaatttccagggaaggagggtgaaaatctctatatttaaacaagcctcccaagtgattctaatcattagccaagttcagggaacactggtttagtctttgcaactcaaagttgattcctgagaatctctagcactgcatctcctggaagcttgttagaaatggagagtctcaagccccactccaaacctactgaatcagaatctcattttaacaagatccccaggtgaaaggactccttattcaataaatggtgctgggatagctggctagccataagcaggtgaacgaaactggaccactacttttcaccatacacaaaaattagctcaagatagattaaaaacttaaatataagacctaaaactataagaaccctggaaaataccattctggacatgggccttgggaatgaatttataactaagtcctcaaaaacagttgcaacaaaaacaaaaattgccaagtgggacctaattaaactgaagagctgcacagcaaaagaaactatcaacagagtagatagacaacctacaaaatgggagaaaatatttgcaaactgtgcatgtgacaaaggtctaatatccagaacctataaggaacttaaacaattgaaagagtaaaaaataaataaccccatcaaaaaatgggcaaaatacatgaacagacacttctgaaaagaagacatacaagcgtccaacgaacatgaaaaaatgctccacatcacacatcaacagagaaatgtaaatcaaaaccacaatgagataccatctcacaccagtcacaatggctatgtgtaaaaagtaaaaacacaacagacactggcaaggctgtagagaaaaggggacatttatacactgttggtgggaatgtaaattagttcagctaccatggaaagcagtttggagacttctcagagaactcaacacagaactaccatttgacccagcaatcccattactgggtatatactcaaaggaaaataaatcattctaccaaaaagacacatgtacttttatgttcactttggcactattcacaatagcaaagacatggaatcgacaacctaagtgcccatcagtggtggactggataaagaaaatgtagttcatatataccataaaatactatgcagccataaaaaagaatgaaatcatgtcgtttgcagcaacatggatgcagctggaggccattatcctaagtgaattaacataggaaaatatcgtaagtgaattaatataagattcccaaccctagttgcacattagattttacctagagtgcttttaagaaatatgatccctgtgtcccaccccaggccaattaaagcagaatctcttaggagttggaggttgggcatcagtatttcattagattattttaggtcccaggtgggtttaatgtgcagccagggttaagacacctaggaagtcgtgatccctctccggcagcagtccccaacctttttggcaagaagaaccagtttcctggaagacaatttttttccacggattcggggatgggtttcaagatgaaactgttccatctcagatcaccaggcactagattctcataaggggtgcgcaacctagatccctcacatgctcagttcacaatagtgtttgcgctcctataagaatctaatgccgctgatctgacagtcggctgagctcaggaggtaagcctgccactcacctcctgctgtgcggccctgtaccggcctgccgcctgggggttggggatccctgctctaaggtaaggctaggaggtgagtccaagaagaatactacgttgtcacacagcctctcccactgcaatacagacataaaatttcatatacttaatcctttagtcccactattttcaaaaagggaaaagggaagggaaggaggaaggggaaagggaagggagaagggagaaagcgagtgagaagagaaggaaaagaaaaaaggaagggaaaaggaaaggggaaaaggaaaaggaaggagaaaggaaaaaggaaaggaaaggagggaagcaaggagggagggagggaaggagatataagagaagaaaaaagtgttataatatgctacataagaaccttatagtttgaatcaattgcaacaatttttattggagcatataaaaaatttcccagttaagttttaaaaaattctgttggggtatcatttacatacagggaaattaatccttttagtgtattgttctgaattttgacaaacccataagcttgtgtaaccaccacggcaatcaaggcacagcaattccttcactcccaaaaatttcactcgtgctgactctgtagttagctcttctttccacctgaagacaaccactgaccacttttctgtctctacaattttgccttttcaggatgtcaaataagtggaatattgattctggcttttttcacatagcataatgaatttcagattcatccatgttgtttcatgtatctgtagtctgttccttttattgttgaatactatcccattgaatggaaatgccactgtttgtttattcacgcaccaattatatgtttgtgtagtttcacaccagtcgatgtttgggtagtttctagtttttggcaattataaataaagccactataaacattcacatacaggtttttgtgcaaatatacattttagtttctcttgggttattacctaggagtaggactgtagcattgtatgacaattttgtgtttaactttataagaaaccgctatgctcttttcaaacagaccccagtgttttggcttctcatcagcaatatatgagagttccagttgttttgcatacttgtcaacatttaatactgccaggctttctggtttgtttcttttagttttagccattctgtgtagtgatatctcattgcggtccttttaagttttgatgccctaaattatcctcaactgtatttttttaaccttgttttttaaaatctagcaggtaacctgttttgttgttattgttttttttcccagcattaaaaaaaacttgtacagaattagacagaagagtataataaatctgtgtgaactgatcacctagcttcaatggttgtcagtatttgccatttcttttcatcagtcaccaccatcaattttgtttctggagtcctttaaagcaaatttcatactttatttcattagttaatatttcaatacgaatccctggaggaacttcaaaaataaagcaaaggtaatcacatataacaaaattagcaataattctttaatatcccctaataatcagtctattttcaaatatcctcaattgcctcaagcatgtcttttaaaaaactgctttgtttaaatttaatttgcttatgatatgaagtggaagctataaaatccaaggtcctacttttttttcaaatgattgtggttccactcaattttcagaaatagtttgaagtcagttcagattttactgagctatagtttatctattcaaattatatttttgttatacaacagcaattgggaattataaggcagatattaagaacattgaattggcatatcatttaactgacagatcaaaacagttaaaagatgcctgccactaatggacagtacagccaattggttctgttggcagtgaatatatgagttggcattaccagtccagggtagtggggagaggacaaatgggtagtaggggaatgggaagggattctttatttggccaacagacagaagggatcacttctctcacctggcattgttacaaataaggtttgttcatagtgggcccctagcacaactatggaattgataaaacactatcaagaggtgtgtgtgtcaccagggcctgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataataaaaaaaaaaacaaatccaaaatattggggttaaaaaaaaagaggggtgtgtgtgtgtgtgtgtgtgtgtgtgtgtgtgtgtgttgtcccagaggtttcatccaaatacaattttggctttattttgtttacaagaattttttctttcattcactttagttagtaagtagacaagactttattgtgaatttgttccattattgcttttatctttttaaaatgtggtttagctcacagccaagtcatataaaagtaattaatatttagatttgaagatcagcatcttggtgatttctgttttgatttttttaagtatatggttcattttaaattccagattggaacaggctttttcttcaatccaaacctatatggattcctacagccttgagctctttttcaacatttgcacaaatgtatttgcttgctctgttaccgtttagtacagataagaaggttcaagtaaatgtaacctgcacaataagaatataatcactgtttaaaatcaaacttcagaacaggtcaacatggcataatctcctgtataaatgatctgtaattcgcctcttcagatagtcatcttggccctggagtggtttaaaagatagtagctgccaaaaattgttaaccattaaacaaagctttgcttttcttttatgtggcaggaacaaaggtacacttttaaatctgtctctgaaaaatgcattggttttgaatccaattcactctacaacccttgcttttgggatccaggaggaacctttccaaaaagggtttttggtttgttttttttgttttgccttcatggagtgacctgagccaaggtatgtgggttttatttccgggggcaaagttgacataaagaaaacttggaaaacccaagggaggcttgaaaggactgtgtattacactggaatgtattccatcaattgtcagagtacttaagaacactgagtcatcatggggaatgtccccttcatgaagtcaacaacgggttggcattatggagaatattcatctctcctattgaaccatagtgcaatttggcagtccacatatttgcctttcatggtagctaaaaagtaaacattcgtatttatgttctatttcataaaattagaccactatattgcttccaacttcaaagaattctgtagtttcactttcaaggcaactctagaagacagtattttaagcactaggggacttgagatgcatacacaaccagcctcttatggattcacttaatcaccattagaacctgaagatctaagtttctacttagttgtctgtgctcatggtaggtttctcccagggcatttctttcatggtcacatttggtttctgccaaattcttcttttgagatttagaatgtctttttagacctttaccaatggaaggaaaatgccaggtatttcattagcataatggacctatatgccaaagccaatgagattatcatgttacttaccaaattccttagatcatacatgttggcaaagtaatcacttccttccacctattaaatttgttgtttttaatgccagatgagagaaacaaagatacttgaagtgatcttttataaccaagtgacttgctactatgaacatttagggttaggcaattctttgttgggagtggggactgtcttgtgcattgtagaatgcttaccagcatccctgacctctacccactgttccagtagaaaccccctctcaagtcacgacaaccacatgttttcaaacattgccaactatgccatggggagcaaaactgccccctgttgagaacgagttttataaacagcaagacaggtattcatctacagtcttttgaattatttattaattaatacattccacagttggctcctgtgtaaggggtagtgctagacatgagggactattggatatgatccttgcacaaggcttgttttcacagagcttatgagtcagcctaggaagctcacaatctaacctcattcttaacatctccctggcaagagtcatgaatcgggtcagtataggatagggcccatttgtaaacttacaccttgcattggctcatgacctgcctatttgaccctgaatccccaaaccagagcacctgtgtagcctcagtgggcactcaaacagggtgattccattctcttttgaactcttccagggtattagatttgtgtcattgattatctactgcccagtttatagacattgtgtacagttcatcattttcttatttttaatgattagtaccctctgtaagatggatttggctggctgcctggatgaatggttcggttgattattttggagcatcttggcagccaaactaaagagtttggagacaatttcttttagtatgggaatgacatgactgattacttagtaatatccacatgtcatggtgctgggaagatttggagaggggaaaacatgaagccaaagagataataaaatgattttatattcctcctatgatcagtaaagtacagtagcagaagagcagcaatgtcaatgaggaacaaaggagcaaaaaggagagccatttcaaagaaaaaataaataagattttggaagagaaaatgatcattacagagaaattgagtcaaaggactcaagttcagtgtgtgtagatatgaaaatgtggtttctccattaaatacaaatataggtgttaagatgaataaaggatatcctgatataccgaggccatcattcttcatgtaactttcctcatttgaaagtaatattcttatgaattttctattcttacattaagtccagctgtaaactaagagcaaccaaacaggaggtaggatgattcactttttgaacaatatcacatgtaaacaattctgtaaaaagcaatgcaatatggatacaagaggcctgaaatcagaatcaataaatctgggctccccagatgacctaagtgaagcctcacatggcattattcaccactcagttcacctcaccacatttctttttcctccatgtgaaaaaagtggctgacaagtgaagatttccttaaattgtagtatttttagaaatgccaattatattaatgatatcctccttattagtaatctccaagtagttacataatgtgcagaatcatctcaagcactaattttaaagtaaatgaatattgagtgtctcatatatgtcagatcacttttctgggcactgagaataaaggggtttataaaataaagtccttgttcttttcctcttggagtttacattctaataggggagacagacaataaacatataaagaaataaatatgtaataaatcatgtggtagtaagtccaatgaagacaactatggcactataataggattgaaagtgattgaggtgttatttttgatcagtgaagtgacatgtgaggagactagaaggaaagcaggaagcagggtatgcaatgtactagagaagactattctgagcaaaggaaacagcaggtgcaatggtcctggaaaggaggagtgcttggccccttagggaaacatcagtgaggccaggtggctggagcagaatgagtgacaggggaaggagaggaagtcaaaagggagtaagagccagtttattaagggctttgtagaccatggaaaggacttcaggattttctccccaaatgtgatgggaagaaattgagagtgttttgagtagacgatgacataatctgattcagtttccagcagtggttctcaaccaggaataatttttgcacccagggtacattggggaatgaatgtctggagacattttggttatcacagctggggagatgtgctcctcgtctcaagtgagcagagattagtgatgttgttaaacatcctacaatgcaaaggacaacccctttcccttaccactgcccattcccaccaccaacacacacagcaaagaattttctgggccaaaatgtcaacagtgcctgtttacaagatatctctaccatcgtgaagagaacagactgtggtggggccagggtaaaagcggggtaaaagtaggagtcaactgcattagactcaggtgtcaggggtagagactggaaagtggtcagattggggatacactgtgaagaccacattaatagaatttgtagataaatttagtataagagatgactcaagaatgactccaagttttctggcatgaactactgagttgaggaatttagggagagtagccagtttgggaagatatcaacaattcatttttgaacatgttaaccttgagaacttgttagctatctaagtgtagatctcaagtagccatctataaatataaatcttagaaacgtgaatctaaagttacatgtttggctgcaaagataaagttgagagtggtattgcaaaggattcttaattgcagacaagagaatccattctagccagtttaaatcaaaaggggatgttacatagttccaataatctctgggtaggatggaacaagacctgatgctatttggtcagaaacaatacagtcagggtatacatccaaccacaccataggaaagttctggtaaaaaacaccactgttgctactatccactatgactttagggactggaaattggagatgtactcaatttgcctcagaccaagcaggtgtcttagccttcatgctagataatcctatctctcttagttacaattggcccaaatcttgcacctggacatttgatgtcacatgtctccactctagctattagaaaaacgtacagttttagctttgcagtttctgtaatattggaaggtgaactagaacagtttggaatgagtgttgaataagtcaacttgctctctatctgcctcaagaagccactggcatatagacggaatttacagttagggtgtttgataaggccacgtggggagagaagaacatttagtgggacgagctcttaggcatcccaacacttggatgtccggtaaggagactgaaaagaatcatgtagtgacaggaatgagaaccaggaaattgtgatatcctagaagccaaaccaggagagtgtttcaaggaataagtgatcaactgtattgaatggtactgtcagatcaattatgggcagataattaaccagtggatttgaaaacactgaggttattcatagtctgacaagagacatttctgtggagtgatggggacaaaagcctgattagaatgggtgcaggagagattgggagagggtgaagtggacacagtgagtataaaagagacagagatatagtcctgcaagttggaggcggaaatggggctaaagaaaggtctttttttcaaatggaaaatatttaaaaattaaatattaaaagaaaagcataacagccacattttaaagcaatccaaccaagttctatattttaaattttctatattttctatattttaaattctctttcacagaaattggtttatgtcttggtctttgccaatactgtgcttttaagcatcgctcctaatcatttagaaagcctccatggggaatgccaagggatttctgatgagcagctcattgccctcggagccttttatatatatacacacacacacatatatacatatatatgtatatatatgtataaaatacatgtatatatacatatatatgtatatatgtataaaaaatcattgccaagatcatcctttcacaactgagatctctgatcttgttcaagcttttcctaaaacatttttcatttttctctacttttaacaaatgagcttcattagaaaatactaccctttgttatccataagaggagttcactttagaaagtggtagaatatgaagatcttgctgtaataatatatctctcttcatctgctgaagcacagctactatgaaaacagaatgagtaactgcttccattcaacactcccagctctccctaaagggaacatgtctgaagaactaagtgatttggtcacctttaatacattttcatttccataatatgctcttaacaattcaaatgacacgtttctccatttaagtctcccactgggcatctctatcttctcacaaactgtttttagttattatcattgtattgtctatggagattaggtttgctgctatgacaaatcaggggagattttaaaggatgacattaatttgacaattttaggagtatttattcatatttttaaatatcaaaaggattagaacagtcatttggttttttccttatatatttcatattttaactttttgtcagatacgaggtttgcaaatattttctcccattatgtaaactgccttttaattttgttgactgtttcctttgctgtgcagaagctttttagtttgatgtagtcccacttgtttatttttgcttttgttgcttgtgcttttggtgtcctacccaaaaaactaattgctaaaatcaatgttagggagcttttcccctgtttcgttttctaggaattttatggtttcaggttttacattgaagtaaacaatttttatgaatggtgaaaaataggaacccaattttgttcttttgcatgtgaatatttagttacccaccaccatttattagaaagactatccttttcccattgtgtattcttggcactcttgccaaatattaattgaccatgtacgtgcagacttatttctgggctatattcctttctagtggtctatgggtctgttttcatgacagtaccatactgtttcgattattaaagctttgtaatatagtttgaattaagaagtgtgatgcctcctgctttcttcttctttctcaagattgccttggctattctgggtcttttgtggttccataggaatttcaggatttttttttttctatttctgtgaaaaatgccaatggaatgtttttagaggttgcaatgagtctaaacatcactttgggtactatggttattttaacaatactaattcttctgatctgtgagcacaggatatctttccattttttgtgtgcctttagtttctttcatcaatgtgttatagttttcagtgtacagatctttcatctctttggttaaatttattcctaagtattttattgtctttgatgctattataaataggattgttttctttctcttttagataattcattgttaatgaataaaaatgcaactaattttttgtacgttgattttgtattctgcaactttattgaattcatttattagttctaacagtttttctggtggagtctttagggttctcttgatataagattgtgtcatcttcaaacagagaaaatgttactttttctgattgggatgtcttttatttttttcttgcttaattgctctgtctaggacttctagtagtatgttgaatagaagtggtgagagtgggcatccttgtgttgttcctgatcttagagaaaaagaattcagcttcccactattgagtataatgttagaggtgggcttgttatatatgacctttattatgttgaggtatacatctatacccaacttgttgacagcttttattatgaaaaaatgttgaattttgttaaatgctttttctgcctctgttgagatgctcatatgatttttatatttcattttgcaaatgtggtatatcacatttattgatttacatgtcaaactctccttgcatcccagagacaaatctcacttgatcatggtatataatctttttgatgtgctgttgaatttggtttactagtatttgtgcatattttcagttcttttcagtttgctgaggtttattttatggcccagaatatggtctatttaaattcaatgttcatcatacttagtgaatattcatatgtttcactacagaaatattcatatgatttatttcttggggcttccctagtctttaatgtgggtgacacacagtatatgtagcatataatattcttaaaatttgaaaaactgtgaattctgaaatacatcttatctcagggatttgggataagaaattcttggttatattatcatccttgtgatctagaataagtttatattatttttagattatcactgacaagaaaacaaataaattttaaaatttcatagaaggacttgcagactcaaaagaatatttccatagaccatggggtctgtggttcccagctaaaaaacttagcaatgatgaatttacagtataatgatgttgagttttctttggctctagctgctttctcagcaaagatctttgaaatgctaaactatctgacaggcaaatttggctggcacttttgctttggattttcttggatgtgatcagaattgccaaaggtaattttattgcttttctgtgatgagtgccgcagattgcaaggaaatcactgaggagaaagagatgaacagttcatgacaagtatcaaccccattttagatcatagctatcttgcttattgaaatctgataattatcaattggaactaagaaaatttcttattgaaaccaagaaggttagcagttttagagaaattctaatgccattcctaaatctgtggtaatgagccggaggcaaatgatatatttaagggtccttaaaattgcaagctttagcccagaattaaataaataattccaatctttatttaaaaatatagtttagtgaaaatgatcaagaggtctctgttgtggttgggcgtggtggctcatgcctgtaatcccagcactttgggaggccaatgagggtggatcacttgaggtcaggagttcaagaccagcctggccaacatggtgaaaccccgtctctactaaaaaaaatacaaaaaaggaaaattagcctggcgtgtttatgtgtgcctgtaatctcatctactcgagaggctgaggcaggaaaatcgcttgaatgcaggaggtgaaggatgcagtgagcccaaattgtgccactgcactccagcctgggcgacaaaatgagactccatcttaaaaaaaaaaagaggcctctgttgtgtaggatgagggggaaagactcaagatcagctacaaaagttaaaccgttaaattcaatggacactgtataggccagccaaacctttgggcaagagaaagacaatacagggagaaaaaacaggcaaagctgtgacatgatttgcattctttaaacataagcattcaaggaatcaagagaatcatgggaaattgactagatattgtaaacgttgatgccacaactgctctgcacattttgcactcctggttgcccaggaactaagacctctgccttatttcaataacattatagagaaattcatgtgctaatttgtaaattcatgtgtaattgggggtggagcagtacatcatctggttggctccaccttgataaagtcttgaacagcaacttggatttgatgtcattaaatagaacaatattaaaagttacttttaactggctgctactgtgttgcttcccctctggactctgggtggactccatgttaagtaataaaagtgatgtgattattcattccagttgaatgacaaggtcttctcttggatacctgctcgaaaggaaaagtccaggaagctgagacttaggactggaaacagatggatgagccatctcaccgtgccctgtgcaggctagagagtgaatgtcagtgcctctattgctgggatgaacctctctctccaccctggggctggggaaatgtggcacacggaaagttagtaggctctacacagcattcttgacaaagcacttatttttcacttatatgtcacctagatatttaaaaaacccaaagagcagatcagagcttttgaggaacccattactaaacacaacccttggtcagggatgttacctagaaaatcctattctgattccactcccatttcaaatttaggaaacatacctgctggtctgcctcagtctcctctatatctgaaatcaacttcagaggcagaatggagatttggttaggtaaatagtgggtatccatagcattctttgaagagacaaaaaggccaagccagggctgcaggcagtcatgaatagaattcttacaccccgtgaaaaatcaagctgtgcatgattctgttccagcactgactactcttggttgcattaagtggctacttccagtgaatgcaaagttcagcctcccaaactgaactgtgtacctgaatactctgggaaggtatccttattttattttccttcaaaaccctacagcctgctggccaggtaaagtaagaaaacatatggtctttatttagttatttagtgcttaccaccaagactaagaggagagtgaggagtgaagatttcttggctgtctccgatgctttcctttaatcttactttatttgctaagagctaataaaaaatctgaagtgcttaactctcaagtgttgcttttcttctgggcattggtatttgatttgtttcttggcctaaactccctccctctttttatcaccaaatgggcgactgtgaacatcctttttaatgctgtgctcattctcttttctttgatatatttttcagcttcttaaagtttatgtttttttccactcttattcaaaaatttaagctacaatcatattagatttatacaaaataatttaattataaaagtaataatctatttttggaaaagatgagaaaatcatttataattttactgtccaattgcaatagctcttgatttattctcttttaatatgtgttgtattttccatagtgacagagtgtgcatagaattctgctccaaatgtctttcaccccatattatcctatcaatgtgatttcatgttcactaattctgctttgtaataattaggttgcttattccactgagtgacattgcctcaatttacttaaccatccttttctcagtgggacatttggattgaaaatatctgcttttaaggctgtattaacactgacaggagttttgtaaagcaatcaaacctgcacaaaattaatacgtaaaacctaataatgtgtgagtctttggatatgaaaatgataagttataaaaacttcgtgacaaataactcaacaagaacaactctccttggttattttcaagacatacttacaactgtagatttggaaagtgagcatatgtatgataatacttaagaatgagtatcagcattcttaaaaaaaaaagtatcactaatacaatcatccatacccatggagtcaatttgctgccatatcttttctgcaacttacccttgaaaatgtgactcttgatatttccaacctccaggtcaaactaattatatctatatcaaaatcttcaatatttgtacaagataagcatttatttcctcatcaattacatagtaagtagcctcttaaatacttttccatattctaatatttacacattctaatttttttcagagaaaattagaaaattgattttttcttctagaaggcttgtatttatctgtagacactaaaaatggaaactaacagcttaataaacctgactgcattattactatcaagcctaatcgccttgttttgtgataatcaggaaattgtaaaatagacaaaaacatgctcttcatcctttgttaattagtgactacactatctctttttaaataaatagtgcctcttaatctggatatcgatcctttttctttttaaaattcttttgctaatgaaatacttgaaatatacagaaatcctagagattcttgatgcaatcatctcctagtcaaacacattttaccaataccaaaaccttttaataatcttacaagatcattactttttttcttacccaatcttttagtatctctttttttctatttaaatatatttttcataaattcttctctatatacctgttttgttttggtaattggcctttctctggatatatattttttactctctcaaactatttaaaaatagtttgtgtcaccttgttttatgtgtttctcttgtgggcagcatatgggtacatttaatttttaatccaatctgataatctccatgtttaatggttttattaatctttttgtgtatatttttactgacatgataaagttattcatgctgtcttttttcctttttctttattatcttttgatttgctactatttttattttccttttctaacatctgtgggatgaataactttttaatctattcttcttttaataagataaggtttgcatttgtattactttagtggttattcatacatgttagcatacacagcgagtttaaatttatctaacagctttaagtttatttggtagtctcaccctcctccaggacatagcaagagctataatgctttaaatagccatagaaacttccgattctcgttattcatttctataattttactcttatctctttcaaaaaaacattttttatcagttatttatgtttatttacatattttattaattttaggctcccaattgcttcttgtaccccacattttcttctgggtttccatttcttcattcagaagcccctcactccttgtaactttattgagtgtctctggctttgagtaactgaaaatgtcttgtctttgcttttgctttagaatgatagttaactgggtataaaatcctgtgttggcatttaccatcaacattttgaggttattaatccattatattctggcattcatttccaattacaaagaaatgcactgggaatataaccaacagggttcagttctctgtcttttctctctggcagctcttaagatattttgtatgttacccttaatgttctgtagtttcattacaagtgtctaggtgtggatttatttccatttatcctccttggtacttggggcattcttttaaattgaagactcatgtctttctccaatttagatattttccagctataataacagtcatttcctccattcttggtgccccacttctctgatgccactccaacacagtcaaagtggtggtttggggcatctcattacagcctggccaggatggaagtctaagctctgcactctgcctttgctggctggggtagaggtacagctgcaatttggtcttttttttttttttttttttttttttttgtgcagtttggctggagtagagtggttagtgtctaaacgttctttatattgccagttgcccttttcctggtttttggctagagagatctggcttttctcaggttttttgtttttttgttttgttttgtttttgtttttgtctgtacctattggcatttccaggtatgcagtttggaatatatgttgcaaaaagaaaacctcaggtcccaaggtccctagctggtctaccttcttttctccacctttcagaggcttgttatatttgttttatgtttaatgttcaggatttttcgtggtacttagctggaaaaataggaaaaagcatgtctactccatcttcctagaagcaaagcctatgtattttaaagtatttgtcagactcctctataaattagtttttaagtaggaagaacttaaataatgatttaattatcaatatttttgctatgtttctcacgttagatttctttgcctgtttttgcattttggtttagaagcaccttttgagaaagaggttttgctttatttttctctctctctctttcaatgatcccttgtctttttctagtcatttcattatttctttctcaagacactagacttcaattctagaaccaggtttaaaatgtaattcaggttcctggctttttttcggtgagctacagttatcacagatctgaaccccaaggcatttggtgacctaactaagttcctagtggatcagctatctctgagttcttccactggtttggcctgtaggtaactgtgaactcagtgagtggtagcagatttttcagtctgttttcactggtggggaaagaggaagccccacttcagccctagctttaagcaatgactttggcccggtgcatccgaagtggagatgaagaaccagagggcatgttagtctcccttactttgaagcgcaactgtcttctgttagactcaggttctgagaggctgctgggttttgcacttctgttattctttttttgggccacagcaatatgttggccaggatgatctcgatctcttcacctcatgatccgcccgccttcgcctccctaagtgttgggattacaggcgtgagccaccacgcctggcctatcacaagcttttaaaatatttttgatatctcattactatgtgttgggagcagaaactgtgcaccaaaacatgaacttgctgggctatcttaatggaaaatctaaattttacttaaacacctttggagacacttggggggagtagtttatataagataacaaactgcaaaaccccacattagctcagattaggttaatttcattaaagaaccagttttcagttaacatcatctatttattagcaatttggacatataattatgtcgttttcttacatcccccttcacatcaacccatcatccaagtaactttgtgttaaattgttattcagtattattgggtgaatataagccaaatgtatactatcactaaattttcttctaaccttctattcccctagtgctgataactgtctcattttcctgggcatagttatctttttatctatggctaattcttcccatatctgattatgggtaatagagatttccatgcagtcaaatatctcagttcatttatcagttacctttttctcctttctgactttcttcccaatactctccaacttcatgtccattaaggccaattactttcttggacttccttctgacagttgtcttctggaaacttctctttgccatcaatctggggattcccttttcctctttcctgtgtcagatctcctttctaaggacctcactacttctttctggatttactatggtgtggctcatgctctagagacttcctaagaaaagatacatgagagataccttttaaaaaactctttgttttactttcactctcaatgagtaggttggctgatatagcattctaggttgaaaattattttcacctagaatttttggaagtcattgatctattttcttctagctactagagttggtaggtcaaatactttttttattcctgatctttcatatgggacctgatttttatctctggaatattttatgatattctcctaatcatctgtattctgcagtttcacaattgtgtgccataatgtgggttttttaaattcttcgaattatggtctcaggaggtcttttcaatcttgagactcaggtacttgagttctggaaatccctcttgaattatgtggcagaacagctaaacttctcattggaatttagtttgtctccttccagagtccacccccaacccctgttctccttacatccaggtaggccagatgataagttctcaccaataataggagaagtgacatctgggctaaggcattgcagaggtaggtggcttactctactctctttcttcccatttgccagatggatgcagcaaatgtcaaggtgctaggatggtagagccacaaggcagaaggatcatgggtcccttagtcatcacaaggagacaagtaaccatgggcattcatctgttatgtgagtgagaaaagtactttaatttgtgaagccactgatgtttaaaggtttgttgtagtagtcagtgttccctgattgatatatttttttgaaatatcctaccaactgctttctctgttcccaaatttctgcaatgttgatcagtgagatatttgacttcttagattaatcttctaatttcttacattttctcacatcctatccatctctttggccttttttccccactttcagtgagtttgatttgttaacttctttcaactattttattgaaaaactttggaggggggatggagagggagagagctatcatatttttttttaatttccaagaatattttctttgattcctcttttatagtatatttcatagtatatagttcaggttcgattaactcaatattcttcttatctctgaggataacaattatagctttaaattatttcctgatttttatatcatttatttcctttttgtatgtgtatgggaagctatttcacaatgtcttaatgatacagggctgccatacttctttagattgaagcactagaagtctgactgaaagctccatgtgggtcagggagcaactagtgagcttcctgtaaaacagttgcatgggccactggcttcttcactggatgagctccaattatgagtcatgaattctccacttggccctgattttccgagaacaatacagggacaggagattgggtgggagtggagagtggggttcccatcattttctatgtatacttgcacttcacccttaccttcaccttaacatgtgccaggtatcacccctagttccaagtctctctagttcaatgtatgcatggagtaagacttctagccttattacaaggactgggaagaaacaattgccggatatgaaaactaaggttgggttatggaggcagagcaagattggttgattgggatcttccacactcccagagttttataagtcaagtggtgtcttagtaattcctttagccaagatgtgggcaacacaggagaaatagtaagtggagtatggtttgaggttctagctaattggcttttttatagggtagaaggaccccagtaacaagaaacgagagataacctggattgccagggtatctgactttggagttgatttgcaaaatcatacccagaaacagaagtgagtgactgaggacagtgagacagggaaaggagaaaaagccacaaaatagtgagttattaagttggtaaatagtgtgggcaactggggctcaagctcgatgagtgccatctggggaactagtagaatagatctcagaagtgttacatcaaactaaatggaagtaaagtcatttatctattgactctcattgcgtctctcattggttactcttggggcatcagcatccccctcatacttcaggggagtgactgttcaaggcctaaagggtctccctctgctttggagaaagtcctgagcaacaaagcaacgagatgccaagactgagatatgacatgttggcagtatgcatggaatgtccatcccagatgcaggaagatcagttaggtaagagcacatagtgaaagataccacgagtatctgctacacagagtggtggaaggaggtgacacaagtgactaaacagaagagaaaagcacctgcctagttcaagggggtcaaagtcagagagttcaagcagagatcctccaaggggccctcaaaaaaggctcacaggacaaaagaccagctttatacatctgccaagcataaagaaaatgaaggcaactcagaagggaccaactctgttcccttttccttccgtttcccactcctccttatgcccaaactcttgactggtctgcccaacatgccagggggttggggaagaggagaaactcaagttcatgcccatttcttcactggaggattcaagtctgggaaaaggataaagtgctgcctttaaatcaagctttctgttttcatctgtatcttggattggacaatgatctgagagctgagactatttgcaactgtctataaccataaaaactacacgttacctaagaaagaacagaaattttttcatcttggggtaggatacattcaacccttctaaataaaagttttatcaggaatgtagcagataagaaataaagttacattttgattgtagcattggctgtgcttattttacctacatgtatcttttcttattttccagggtagaccatattttccaaaatgaaaaaggtgatgaaggatacggcaggcagaaagcttggcttgaggctatgagaatgaatccaaattccttaccactgctcataaggctcagtgtggtcctgagcctgcttatccctcctagtcatgtaacactctcttcttcaaattctatgcttcagccacagggagaacccttcacttctggcagagtatcaacgtgtagttcctcccctgtcctccacattgttgttctctctccactctcccacctcctctgttttctcttatgctcacctaacttactattcactagatctcaaatttcgcctccttcaggaagaccttcaagtacccaagttcaaggcactccctgtgctccatctctcctagcaccttatcgctactatatttacttgttcactttgtggtgtactccttgcccatacccactatcacaatctctgtaagagatggtctgtctggctcttgccttcatccccagaagttagtatagtgtctggcatacagtgggaaattaatgtcaaatgaattaatttgtgtatttacataaaacgtctgataaatgtatataaatcaagccacagattttaaaaaataagctttactataaataataaaatgaaaagatataggaactatccttgaaaattcaggatttatattggctatatatagtgagtatatatctcataagagagtgtttctcaaagtgttgtctctggaccagcagcatcacctgggagcttgttagaaatgcaaattatcagcagggaaacccaccctacctcactctcaactcagaaactctgggagaggggcccagcatctgtgtttaataagccctctggagcatgctcaagtttgagaaccactgccctaatatttgaaatgcccctccctgcaaagagcttaagtcatattttaaaggagatggtgtgtctattaaacatccctgaaagttgagatctgtatattctccttctccttgatgtcattcaagttaaccatccaaactaaagactgtccaacacagtccattacaagaggactcagctggaaaggattacaaatgagcactactgtcaatatctacaaacggtctccaggtgtgtgcatctggcatgactggctaggaaatcactggattacttgcttcatttagttctgcattttaacagtctgacattttaaacttcatggctggatttttaatcagatgggctgatctctgtacctatcttggcatgacaatttactttgtgggagagttgaattagcaaaggtgttaagcctcaggtttggccaaggggagaggaagtgacatttaaaatgtatgaccattccatatgggacttaagatcaaagcctcctgttggataaggacagtgaagagccatatagaaatcatccagaaccttcagtgggtatttactgattccttcacctgaggaagctgtatattattaaatccctttcaagttcaggcagacaggaagtcttgtatcctgggttagattctattttatccatgaggatcaccaataggaccaatgggaaagacctaagacataggaaggaaaatacatttttaaatgtagtaaaatgacaacagcaaaaacaaaaaaccaagaagagcacaaagaaagaaaaaaagagtgaagatttgttaattagggttaacaaaaaacaaataataaacaaatgaaaaatgccagacactatgtagagaaggaaaaaaaagagaagaataaaaatgccagccatcttaggtgctaatggctgtctacttattctttagaattgctctgtccaagaaggaaactgctagtcatatgaagctacttatattaaaatcaattaaaattacatacaattaaaaattcagtttctccattacacaagacacatttcaattgttctatagtcacatgtcgttaccatattgaacagcacagattagaacactcccatcatcatagaaagttggattggacagtgctcctatagaacttactttaagatcaaacttgtacttttccctgtccttccaggggtatctaaatccacagaatatggaaaactaaaaggttaaggtccagggatgcaagtaattttgctttgttgatgaattagaattttccctgaaattcagtgcaaacatggtctggtttgtttgtctacacatctctcaagcatatattcaacacaattcaacacaccaaatgttaacttggatgccccttctgggcaagacactaccctgagcaccacctgaagagtaaagatacatagaatatagtccctgttttccagggacatatttgacagagcacgtaagactaggacataattataatacaagataagaaaaataggtacattgggaggggtataaaaaaaggtgtgggtctttagtcttgctgtgcatataattgccttgttaaaaatacagatgtttcagcatcatccctagacaggtctatttgttggctctgagagaagcttccagcatcaagcatgtaccttctttatggatgcagatatctgtaagatggctggtgactttaaggaggcggggcagtacaagggaatgcacattggtgtggaagtcaacagaaaaacgatttataaactggctttggcacagatatttgtgtgctgttgatcaaaccacttcagcaacttaactagtgactatggtcaaaatggctgattatgattcatgtttgaatcttcaaatgtcaaaagaacaatttaaattcttgagtaggaaaatgaactcaggaattagtgagatctgaatggaataaaagggaaaccaagtcctgaagtcaccagaattactcaagggacttaagccaaaccagaagacaatatagacaatcctttggggacagatgagtcacctatgatacttatcaagttattaattaatataggtagatcagcaatccttaagggaagagcacactctttatagataaatagaacacatttggaatacagggaagcattccttgggatacaatacataaagctgagagtagctggtaaaattatgtacaaagatgctgcatttattaggtgacaaatgagcaactttctgaccacacattgcccatagataacttctagcccattccttggcagtaatggctttcacatcaatggctgattgacttgggccagtgtgatggacacctctcctgtggctgggcaaaaccagaaaaatcaatattaagtttgtggttgacttcaatcacattgtagcctaaaaagtacataagtatttaaattttaactttttcatcctcatccttggtttctttcttgtccatctattctaggatattgcaaatacttccttcctccctccttttatttctcctcttctcctcctcctcctcctccttcaagattggagatgaaggggtttgctgtttcttaactggatatagcagataaagaacaagaatattggctcactcgaagttgtcctaatttccttcattttaacatatttcttcaccaccaccagaatgccttctctaatgacaaacaatttcctgctacaccatatttcaagactttaatccttgtgaatggccatgcaaatgttagattttgtaagtcataagcagttttctaaggaatttttaatcgagtttcattggacatgcaggctaaaatgcaatttctggcttttattacacaccaaaagtctgtctttcaaataaatcatcaaaggaaaattggggtgcaatacatagcagataagaggcaagaccatcatataagaccatactggttgtacattgcacaactacaggaaaagtcattcataaagtctttgatgtgaatagtgttccctggagttgtacagtgtacaacctgctcagctgctcatgacagacataacagtaagatttctatataattatcataggctatttgttcatgtaattaagtgtttattgggtgctgatcatatgtcaggctctgtgctagatcctggtgagctaaagtaatgaagtctctgtcctcatggagttaatatgacattaggagggtcaaagaattaaggaagcattcatgatgaaagcaagttaggtactataagaattatagggtgacatggagcacagagaagggagcctctttgggaatgggtaaggggagattcctaaagcaattgacattgttgtgaaatattagaaataaacaggaattagataagccaaatgagtaatatgattggaatggagagggggaaggggatgctgaggagggaacattccagaaagactattatgcatgaaaagaactaaatgatgtgtgatgtgctgagtcatcagctacttcctgatgccagttttattggagccaaatgtgcttgctgtattagtgctcatggcagagccaagccatggatcatgcttggagaagatgttatctctaggcagtcacatggacaactgtactttgcacctgcttggtgacacttgtatgtaatcttatgttttgctccaaagtaaatggggtactttactccccactcaactgtgggagctcattaagaagagagtatgtcttactttccgatgtcctttatgctatctttgcatgtggcaggtgtccaataaatattgatagaaaataattaaaccatcatctaacaagataaatcagcataagataaggaattgggattcttttttcctttttccaacctttcaattaagtgaaaccaacatagacatgtaagctgggaagattttgagcctggtttttctgatttcaattgtgttgttagtgaacacatcctgatattgtaatatgacagaaaaggacatttaaacaaacaatgatatgtgcagccaaagatccatgatctcatgttttgattccaatcttataaacacttgaaagtagctttataggtatcttgggctaagacacctctgagagagcatatagttcttgtgcagtcattggaaagaaaacacagtatcctattccaataaaagtttcagacagggcagtaaatcaggcttgccttccagaatgcaacattaggccattggtttgggcataacatttggtaatatcattgagacactgaaggtgatcaccataacccacatatatctgcagttctaagggcagctttatgttgaagccagaacatgacgatggcatgcagttttctgttgttgttgttgttgttttacctcatatggtgaagaccatagagactaccagccagtaacccattaacaagattaacctttgccttgacaccaggggagtgacttttctcaaagctcataaaatatctttgcatctccactgataagtttgcaatgacagtggggaaatttcttaagttatttcactcagcttaaaaatttttaagaagtctgattgcaaaaatgctcattgacctttcaattacactactcctttctcttattagtgacaatgttgccagcagcagtgaggatgagtgacctaaaaaatgtgggctttcataattcggccgatattttcagtttgtatttaggagattttacttccaattttctcctggcttttgcaccgctttaatttctcacaagctctggttccagaatagctatgccaaatttggtcatccatgatgacagtgtcataagtcatagaaatattgggctccaaatttctttggagaacaaattcagatttaatgctgccaataccccatatttcttgggagaaatatgtgaaaatctttggtttcacttataggaatactcaaagaaatgaataaacttgcccatttaagaggtttacatttactgtatagtctcaatactttaaattctgatgatcttggattacactgggctatttcaacacttaatttttcacagtttcttgaggctttcaaaaaaacaaatatacttttcaggtacaaataattgatatgttacaacattgatataagtatcttcataattgagcatctttctatatttgctttgcgcatagctgtccagtgaattttttgaaaagaatgaacagttctataaatatttctctatatccatcagccaaaatatgttaaggccagactgtcacctagataattttaaaacagcatacttccaattgtaaaatgcagttcaaaccactcatcattttcagtcttttggcatctctctggtccacaggtctatgttctcataggccagcccagctcctaggaatagtcaggttgatcacagtattcagcgactgtggctacagaaaacaggggctagaatatcccagtggaatgtctaacaactggaaggagcatgttgacaagcaatcccaggagcaggcagacaagaaatttcaggaaggttcttccctgagctggtggggagcaaaaaaatatagccctccaccagtgtaggaaaactagaagggatgaagatggtacagccctagggaggctgagctgattctaatttactgagattcagattgaactcaagagatgagccagtacgctacaatttgaggtggctgtcctgggaacaaagaagaactccagttatatgacccaggggcaagatcagagccaaaatggcagccaggagggcatgagaggatattctgggtattaaaccagaattccttaaatccccccaacaaagataaaggttgggtctagaaactagcatgagattaaagtaaagtgactgtgccagggtgacttcagtggtggctgttttcacactgctttaagaaacacctgagactgggtcatttataaagaaaagcaggttcaattgactcatagttcacgtggctgggaggcctcaggaaacttacagtcatgatggaaggggaagcaaggcacgttttacatggtggcaggagaaagagagaggaagtagtacacctttaaaccatcagatcacatgagaactcattcactatcacgaaaacaggatgggggaaactgcccccatgatccaatcacctcccaccaggtccctccctcaagacgtggggattacagttcgagatgagatttgggtgggggcataaaggccaaccatatcagtggccctgttttccaggccatatgaatgtttaccccacgctgcagggccctcaatagctccattttctcccgcggctgagccattgtactttctagaaaaagtctttcttcatgactgaaggttcaatcttgtgccagtttccagacccaacctttatctttgttggggggatttaaggaattctggtttaatacccagaatatcctctcatgccctcctggctgccattttggctctgttcttgcccctgggtcatataactggagttcttctttgttcccaggacagccacctcaaattgtagcgtactggctcatctcttgagttcaatctgaatctcagtaaatcagaatcagctcagcctccttagggctgtaccatcttcatcccttctaattttcctacaatggtggagggctgtattttcttgctccccaccagctcagggaagaaccttcctgaaatcttttgcctgcccgctactgggattgcttgccaacatgctccttccagttgttagacactccactgggacattctagcccctgttttctgtagccacagtggctggataccatgatctatctgtgtattagttcatattctccaagaagccgataccaagacaagatgaagtgtgcaagtatttcattaggggacatgcctacatgaaaggaactaggaggaaaatggagtaggccaggagagcattcagtttgtgatgcaaattgacttccagtgaaggagagaggaggaaaagatggaagctcctagactgtccttctggcttaggaaggtttgggaaagccaccaagggcatcttagccaaagtcacccatcaaaaaggtactgtgtctcttaggaaaggacctgccttagaatcccctcagccccaatcacatttagccattggtagagaacagcctgtgggaaaggggccttggcacatacccactgatagatttcagagtgcactagatggagtttcagtcaattacatcccctggagtcacaggtgtgccaggtgcatgctcatgaccttcacaacttgtcagtttggactttcttccagcacccgaagctgggtctgtaccccaaggtgctagtctcactctacaaacatgctgttttaccttcaggtcccagtctctcctagcctgctttatccagctggaatcaacagacagccaggtcgggccttatcatgagcagcgttttcaagtgtgaattccttcctggcatttctccagaaatttatatggacttctaaaacccgaattccaagaaaaattcattgaaacattgagggaatgagaaaaaatgttacaattctccttgaaaagttaaaactgaacaatcaacacaaagacataactggtttgatggaagccactgacaaaaagtcaaaagagcaggaaactctgacatggagtcaaagatcaaggctggaatttccagaaccatgacaggagtacagaacagtggtcatgagctaatcagtcagcctttcttgcagctgttgccatgttatatgtgtgtgtttgttgcagataaagtaaatattaataagtttatatgcatagtatgctttatagaaatcatatgattgctcttccaaaaaaaataacaagttttttaagcaaaataagtcctttaactggcagtttccacatatgactctgggaagtgatgttaattttattaggagatctgaatgtgaggttattcgtatattacccaataatatttgtcagcatttttcagtgtttgaatatttgttataaaacataattcttggtaaaaaaaaatagtaaactgaaaattcctttttattacatcattttaatgtccataataataagatatgaagaatggtggaagtatttaaagaataacatatgacttagaataatttgtgaaatttccaagaattccagtatctcattccaagtcttgaagactagaaatactgtgagataaagcttgggaattctccaggattgattagagaaatgatgatgactaaaatgagactgctgttttcgcttttatccaatcagaactcaatcctcttagccaatctaaactttaatctcagtgctgtgagcctaatttaactgcttcttcagaataaggaaaataattacaccatgcaaatttcaattgtgaattttcccaacttaggaaaagatcaatagttttaaatatttgtcctctatagggcttggcaacaacatggctaaaaataaaagcgatattacaactaaaaagaaaaacacaccactatagccatgctattgctgcagaaattttcatatacttgacctctgattaacatgtcatctctctaaagagctattctcaattttactccagtgtcttagtctgcacaggctgccataacaaaataccatggactaagtggcttaaacaacataagtctatttctcacagctctagaggttggggagttcaacatcaaggcactggccagtagggttcctggtgtctctctgaggtcctttcttataacatcactaatttcatcatgagggccctactctcatggcctcacctaaccctaattatctcccaaggacgccatcttaaataccatcctgttgggttgtagggcttcaacatgagaacctggggtggaggacacaaacatttggttcataacatctgacatggctttcttgagaccagaaccagctcatgaaaagagtccaatcaggtaagcataactgggcagttcctaccacttctccttggtgctccttattcccccaggaaccagtcccttagggtcctcatggggggcctctctctgggatttggggagcaactgaagggggcagcacattcccacgtacagagggcagaccatgtgcaggggcttcacaaacatcatcaactttcacccttccagcatccctgctgggagcacctcttccattttcagaagagagacatttggggttgaaccagtttcaataattcatatgcccatgtcacagaaaaagtaaggactagagctagtcttttcttaaagatacaattcagatattagagaattcaccctttcaaattatacagttcagcagtttttagtatattcataacatgcaaccatcacccctatcgaatttcagaacatttatatcacccctaaaagaaatcccataccctttagcagtcactcctcattcttccctttccttggctcctggcaaccacttatttaccttctgtttccatggacttgcctattttagacatttcatataaatggagtcatacatgttttttgttatctggcttctttcacttaacataaacattttcaagggtcatctatgttgcagcatgaatccctacttcattcctgtttatggcttaataatattccattgtatggatataccacttttaattatccatttatcaattgataaacatttgggttgtttccaccattttggcttttatgaataatgctgttatgaacattcatgtacaagtttttgtactgacatatgttttcctttcccttggctatataccttaggagttgaattgctgggtcatatggtaactctgtgtttaactttttggagaacttccgacagacctagttttgaaccaaaatacgtctatgttctttccaccacatcaagcagttatcacaacttcgctcaatctttgttgcacattctaagcacttggagacctttgaaaatactctgaagcccaggtgtcccctatgcaagcgattctgatttaattggtctaaggtggggcttagacactggtgtttgttcctactgggaagtcaaggtggagaatcatagcattccactttatgcattccagatctatggacctttcagctgaggtcagtctccctactgttgataaagggaaataacaggctaaaccactctgggaaggtgttgcccctttcttggccacatcatattttaacagagtaaagatgcatatgtctttgagcattagatttgcctttgaagcatggtgaggctatggtaggccggcaggccccttggtgcctagtgtgcatccatgaaggtaagggcccattacttttcctgacgtctgggataacattattgtctgtgaaccttgcgataaccctctgagatagtgattgtcatgatctccattttgtagatgaaaatgctaaagcttggagagtttgaaccccttgcctgaggtcctcaagtggtggagctggaattcaaaccgcaggcatccaactccagagtcctcagtcataactgatctgtgatattgactctattctaataaacaactttaacaaaatctgtgatattgactctcttctaataaacaactttaactttattcatcttaattactgaaaaaataatcaccaaacatagtactctatatgaccaaaaccaaaatgaaacactctggtgagaaatgaaccaaagactttgaaatctggctaaaggcattaagaaaataagtactgatatcagaaaatttcagatgttctgtcttccaaacttatgttgggaacctgaccctagagcacaagatatattttccttgtccccatgatggatatatttaatgattcttttctggtctgagaatggggaatctgataatgcaccatatacagttacattgttctgagtctgggaggacttctgaagattgaaaagcttactaaaagtttaccagcacagtgcagcctaagctgccatctccttccaccgaccaaaccatatcagtttcaaaaccatctctctcagtagcctctggttttatttaatttactgcatttggaatttgataagttcctggctagctttcacattctttttcatcctagtaattcacgtattatctttcagctttcaattcttcgaatcttctcgttactcctagagaaaaactgctttagtgttttatccatttaatgcctcaaaaacatagtcaaacatggggatatatattcttaccccaaaatgtctctgtggtccaggaactcctcaatgtccaacattttgggaggtccattttttgtgcacaccccccactgaggatctacagatgaaagagtgtccctaccctacaggagctcacatttttgtgggacgaacagacaacagccagttaaaaaataatataggcattccaatagaggtatggtatgtggtgctgcccaaactcatgattgaggaagcttgcacagactgtggaggccaaggaatatattttttaggaggctgtgggccatgatgagtaaacagggacaactgcatcccaggaggtgggaggcatccccaaagcaacatctgtgaaagtagatgtgatctgaccacagactgtgggacatggaatgaagagatataaaatggctaatccatatatagtcttaccatatgccactcatagtttttcctgcttaataactgcttgttaatcctcacaactcctgggatataggtactactatttagagatgaggaaatgaaggcagagagaggtcagagtgcccagtaaggtataaagctaggatgcaagcccaggcagcctggagccagagtacacagtttaattctaccaggcaggtatgcagagcatgcatgagatcatgactgactttgccagttcattccattcattcattcacttgttcattcattcattcagcacatattcatggaatgctactatatggcaaggatggtaatagacttgaggataaaacagacaaggcccttgaattctatccttaaggcaacggtgtgggcagagcagtgggtgggctgccgtttgactaagatacaaatggaataataagacatgggccctgccttttgggtgctcaaggtctaacaagagagaatgctgtaagaacaggaaacattccattaaaaaaattcgttcaatattatggaaagaaaatttagactgagcattgaacctaacaaaaattaatctcaaaatgagtaagtgagcaaagattggtaaataataggttattacgcaaatgggagaaagttggagatagctgataccaattgaaagggaatgcaacttgatatgaaaagtgaaatggagcagaggcaggacaagcttacagggctggcaaatgccacctggaggcaccatgaacatgacttggttctctatcaaaatccttcagggtccaggcgcctgtaatcccaacactttgggaggcagaggcgggaggattgttcgagcccaggagttcaaggccagcctgggcaatatagagaccccaactctacaaaaaataaaaaaattagccagatgtgttggtgcatatctgtagtcctagctacttgagaggctgaggtgggaagatcacttaaacccaggagttggaggctgcagcaagctatgattatgccactgcactccagcctgggtgatagagcaagaccttgtctctaaaaacacaaaaacaagagcccacaaaatacatcaagacttctcttggaatgttcaaggatgttgccagcacatagttgtacctggaagccagcctcaaaaagctctctggctgaccaagagaagaactaaaggaagatagttacaaattcttccacgaacatacccaattcataccctctggccttaatgactttggcagactgggcacaaaacacatgacccatcagctcctgactgactgacttgccccaatgtgaacccccacacctccactcacctcccctatctctttcaaaacttgccagtgacaggagagaggaaactactgggctcagaacattttttcttaaaaatctttccaaagttcctttttaaaccgaagcagggacaacactttaggaaactctttccaaagcagatttttctgcttgaccaaaggtataatttttcctccaggaagtgaaggcacctcatgctggtgtaatcgagtttccctgggaagaagccgctgccccctgggtggtcattgctgttgaaaaattaaacacagatgtttggcgggtcgcctccccatgcatcccactctttgtgtgtttcctcttagagagatgggagcagattcaggacatccctgacatgctgggcctacgtactcatcaacacatccatgcagtttgctgttatagaaacctctgaaactaattggtcatccagtgaatccattgggcaccaccatattggttatcccttctctcaaccatcgtcccagccaatgaacacagcagtatgccccttcttatttgaggaattatgaaaaagcttacgaatttgtgaaatgcaatgcagattttaaagctataaagctatgttcttatttactcttttgggaaataaatgccaattattttaacctgtcatacgaaggggaaatgaaagggtgaaggttgtttccccaacatggtgctattaagtgaggatcacggatattgacttgttagtgcagccatcaattaatagtaatttttgaaaaattatgagcggaaataggaataagttaaacttttaaatctcacctttacaaatatcctactaagtcttctatcttaaaataaaaacatatttattcctgtccctctcaagttagtccatcctttatttcctgtcatttataacaaaacttttgaaaaactatctggactccctgaagccaatttttcttttcccatgcattttatactgcttcaatttatttacctcactataaaactcatttacatgaaaacctcccaaacacaaagcaaatcagctctgtttttcagctaatttcattttctttccagtcctccactctctaattttaggaccacgctgtaatcaggcttgtgcatcagtgcaagctggcttcctgtactagctcattgcaatgctcttccttggtgggtccttaaacaggccaataaaatcatagtaaaagcactgtctacaacttcattctgcagcacaaatattaatctattgtcagttattatttgcaggcagcagtattttctagtatcaacaaatctgtccaaatctggtacgatgccaaaaaactcatcatgacacacaattaaaatactgtgtttccacccattttagtcagggcccataaatagagtatgtgtacatatgtgtgctgtgtaccctttaagtatacaaatgtcacttagtcatcttgcacttctataattgtgctcactgaatgtgttgcttccttaataataactgtaggctagggtgattgattgatttgcaagtgtattcactctccagtagtaaaccctgcaagcaacttttgagtaattatggggtaagggagggaataagtcaaagctttaaaatcaccttcaaaacatgcagttatttctcctatctcccaatttttctccagatagtgacacatttctcaacttccttttacaaggagactccttccaagtgttgtttctatttcctctttccactttcctgcctcccagtcttgtgaacctcctcttttcaagccattgcagccaccaaagctgttctaatgaaggatcactagttacttcaacattactacatctaacattagttctcagtccatatcaggtgtggctcatgggcagcattttacaaagctcatcactatccctgaaacactttctaggctgggcgtggtggctcacacctgtaatcccagcactttgggaggctgatgcaggaggatcacttgaggccaggagtttgagaccagtctggccaacatggtgaaaccctgtctctactaaatacacaaaaattagccagacgtggtggcatgtgcctgtaatcccagctacttgagaggctgaggtatgagaattgcttgagcctgggaggacaagactgaattgagctgagatcacaccactgcacaccagcctgagtgacagagcaagattgtctaaaacaaacaaacaaacaaacaaacaaacaaacaaacagggaagaaagaaaaagaagaaacatttcctattcttgactgtcaggataggcacaggaaaaccatcttggtttttgttctgctcctctgtttctcctgagcctgcttcactgatcccttctcctcttcctttcttgttcccttttttttttcaaattaaggtgaaattcacataacacaaaagaaaccatttcaaagtgaacaattatatggcatttagtacatccacaatgttgtccagccacccacctctatctagtttcaaaacaatgttatcactccaagacgagatcctgtatccataaaaaggtcactcaacattctcccctccacctaacccctggtaaccactaatctgctttctgtttctatggattttattattctggttattcatataaatagaatatgtatttatatgaatacatattcctataatagaatatggaccacccaggtccacactactgttactcttttctggattatcacaatggtcccctgactggtttctctgcttctgccaaggttgggttataaaacacaaaaagacacacacacacacacacacacacacaccccaacatcaactcctcaggactctgtctttttggatgttttcacaaactgttagcctgcttctgattataaaagatttcatatgtcttttgtgtctggcttctttcacttagcacaagcttttcaaggtacatccatgttgtcctatgtgtcagtacttcattcctttatgaatgaagactattctactgtatagatagaccataacttgtttcatctgttgatagacatctgggttgtttacttttgtgctattttgcccctgacttgttaatatcagcatgctctggggcttagtcctcccacctcttctctctgttttcctttccatatcagtcttcagtggatctattccagttgcatgattttatgtgatatctgaatgctgtatatctccagctcagacctctctcccagttaaatatactcttatatttaactgcctgctcagcatccattgttgggtgtttaataagcatgtcaaatgcaacatgtccaaaatgatactttttatattctcccacctaccctttactaccaatcctgcttctcccagtcttccccatctcagttaatgacaactccatccacttgcatgctttggccaaagtacttagagacacccttgattcgtcctgtattcacatttgatccattagcaaatcctatcacccgctctcatcacctccacttggaccacccaggtccacactgccgttactcttttctggattatcacaatggtcccctgactggtttctctgcttctgccaaggttgggttataaaacacaaaaagacacacacacacacacagaccccaatatcaactcctcaggactctgtctttttggatgttttcacaaactgttagcctgcttctgattataaaagatttcttaggcaaaagcattatgaccttccaggagaagttgaaatgtatccattatcagctggcaagaatacgctcagatgaaataaatatggaagaaatgactttatttactctcaaatgtgcttgttttctggctttattttccttgtttccaattcttaaggaaaaaaaaatcaacataaattaagttccttaggtccgctccaagggaaaggaacaaattcttctttttgcaatttcgatagtaatcttcctccatccattttaatatatggactaacttctaaccccctgtccagcttctattccatgtatgtgaattaactccatgttgcctaagtatttaaaaggacagtaaattaactctactgaacatactcacagaagtcagcatagcagcaccaaaaacttacatcagagttcaattagccacaaactatttttttcttgtcaaatgtataattacaccactattattttcaagaaaagaaaattgtgatataatatcactgccaacttatctttccataaggcagtgattttcatcttggggctattttgtctcccagggcacatcttgcaatagctggacacgtttttggttgttgcatggtgatggaggattgctaatggcatctagtgggtagaggccagggatgcttctaaacatcctacagtgcagagggcagtctcccatcacaaagaactacctggcccaaaatatcacaagtgtcaagttttagaaacttagctttgaagttacaacactcattactccatggggccatgggagataagtccagttttaaaagatttacattttataagtaaacttctggttttcagacttttgatgcctttcattgaaggcacagcttttacattttcatctcggataatgttatataaattaacatatgtcatctttaaagtcacccatgtagcacgaaactgacttttggaactactatgagaaaaactcagtaactactaatttcctgaaacactgatctggcaccaaacagataccctggagatgaacagagaagcatgaagcatagtccattgtatacagtgtgtgtgggaaagatctggtgatatctcgactccagttcaggatgtgcaggatgtgtttgaaatacaagtttctggatggtttgttagtgtctacatttatcaacctgatatagtattcaaatcctttttgggtctaatagggtcccacaatttctataaatgaatgtggtgtgagatgacttagaatgcttttatttcaaaacattcaaatcaatctctccctattacatgtataaacataggtataggtataggtataaccctgtaaccactggggccacattaaattaaaaatctcacatctattgtgttctctactttaagaggttaactaaaacattagcttcccagaatgtggatacttaatggactttaatgaagatctagtgcaaccactcctttttattacaaatgaggaaagagaggatcccagaggatatgagacttttccaaggccaaagagctggttattggccaatcctggacaagagctcctcttctgttaaaatattctgggattattccaacaagctaatctttctttgcttaacttatttggaatcaaactttccacaactgctgcataaagttgtgttggctaatttattgtgtctataaacttggtataagtccctgagcaagttacttattcccatccttttgtctgaagtgaaaatcttccactaggcacacagcacaatgctgtcttctctgaggtgagctgaaaagtattatataattcaggctttataagtgcaatgtgtgatacataatacttaatatataatatggtacagttaatgatttttttctcataatggcttctgaggtattataccacttttagaacactactttcttcccagaatatcaattttttcaccccaaaacacactaaatgaactaaaagaagtgatatgtcaacattattaatttagacaaagatatcttcatcaatttacttgacacaacaatttttagtaagagaatatagtaatatgaaacaagttttatgtctaccatgcttgaacgaactcaaagggttttgcttggtttttaagctaaggaagaaggataaactggttgatggctgttggccacatgtgccatttcctcatttttgagacacaccttaatgttgcccccttggtatatatttctttctgcactatttgtaagtgtattctgaatataatgcaaccatgagccccaaaagattgggaagttgggaaagaaaatgagtcacaaaaaaatgactcaacaaatcttcacaacatttatatttataggtacaaaatctacttatgtatttatctatttagtatccatttaatctaattagtgaacttttttatttcatggttttcagtaatgaattactgtttttaagcaaagaataaagctgaaagtgatttgggatttttatcataaagccaagtactcaagcactctccacagttataactctacaggttgccgctccctgttccctagtagaattaattattaaaacatttgattccagatcttttattctctttgtatatcttctctttttatcttttcctacaagctagataccacggtattgtaacagacacttcaaaaatgcctggagtcaggcatgggactttattaggaggctctggctggagctttttgcaatgaaaactaaataattctgcatttaaatggaaatgaaaatatttcatcctgaattatctttacgagatgatttcggctttaacatatgaaaatagcagttgagattgttatctgtgaatttctcaggagctccattttcggactatgtggtctattttaaacacaccatatggattatgtactctaagaactactctcgactaaaaaaaaaaaaaaaaaaaaaactttgcaaacacaaaccacccagctctaaagtcccagctggcacttctgttacccataagtgctctcttctgtttatgtttcttacacccacatgtatatatgtttgcagttggaacccttcacccttgtctcttaaaaattccttgagcaacaaggcaactgcgaatgagattttgctccatttcttgtagcacgaacaaggccaacactgcaggcagacagctggtgagagaacacatggtccagaatcttctcctcctcctcttccatctaaatttgcttgtcttgtgttccattcccttgaggctcaactctctgctctcattgatgccacccagtctgatgaaccagcatttcccaaagatgtgtgttttacaagctgttagcaagagtcccatgaaaagatgggttccatggttaaaagcataggaagtcagaacttatcaaaaccttttatgcccaggactttccatgttattgttcattataaatatattagatgggatagcaaagtacagatttttaaaaaatgtttaaatattttcatatttttccccgagtgtcctacagaaagaatagaccatagaactcattttgggaaatactgctaatgttaatggcataaaggaacttttcaagatctaacactatatcccagtggcatgggtctcaagtaggacaggcaggctgcaggggaagctatttttaaataagtggagctattggcacatatcagggaccaccacacaagtggttgccagtttccgtctgataatagagttccctgtgacatagtcacattgtcacacatctaggagtgacagcaatgatttcagggataatgaactacacaagagcaatgcagaaagtagacagaaattttaactgcacttttcagggtttatgaattacaaatagtagcaatcctttcatcctccactacacaatgattaccttaagtatggagatcaggttgttccttgatgttgccctaggctcgactatgtacagggtctggcacatgtgtgcactccataaatatttgcagaatgactcattgaagcagtgatcaccagatttggtcattcagctcagtttttatctttctatcttctctacaattccaatcaccttttcacatatgatcatgggaatctgtagatacggaaaccagagaggacatctagtctgctatttgtcatcagtctgaaagctacatctattagatgaatgacagctcccctatctttacaaaccccagtaaaagaggcttcaaatcttccttattaccttgtttgagttgaattacactcactactaggaaactcaatctcaatcgcaccttctatcttatgtaagcattcaaaaggcactggagggatggtggccatttccctggatgtatcaagtccaaccataaccctttgtcaaaagcaccaaagaacaatatttttcttgatgcatgatcagatgaaggacgttctctggaatctaatttccattcccaccttttaaaaaatacacacacacatacacatatacacacatgcatatatctgtgtgtatgagagtgtatttatatgtgagtatgtgtgctaatatcatcacttggctaatcatgtaggttcaagattttagccattttcatatcctcctccttctgtgaactttgcttatttaattaactactgaattgggtttatactgcttctgaaatgatgttcgtgcccattggatcatctccaaattactactactagttcagccttctttctctttcatttagactatgcagtaggcttcaaactggtagagagatgtttccaaactccccatccagtattgtatttgtatagcaacttataactgctaaaatgtcttctaatatattattttatgcatatgacaattctgtggactaggcagtatggcctctgtgtgcagatgaggtagtggtgaacagtaaacaattagctcagtgtcccaccactattaatttatgtgtcaacaaatcacctcttttctcctcctcttttttccccatagaccttaggtatttttttttattatactttaagttctagggtacatgtgcacaacgtgcaggtttgttccatatgtatacatgtgccatgttggtgtgctgcacccattaactcgtcatttacattaggtatatctcctaatgctatccctcccccctccccccaccccacaacaggccccagtgtgtgatgttccccttcctgtgtccaagtgttctcattgtttaattcccacctatgagtgagaacatgcggtgtttggtttttttgtccttgtgatagtttgctgagaatgatggtttccagcttcatccatgtccctacaaaggacatgaactcatcgttttttatagctgcatagtattccatggtgtatatgtgccccattttcttaatccagtctatcactgatggacatctggttggttccaagtctttgctattgggaatagtgcttcaataaatatacatgtgcatgtgtctttatagcagcatgatttctaatcctttgggcatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgacttttgaatgatcgccattctaactggcgtgagatggtatctcattgtggttttgatttgcatttctctgatggccagtgatgatgagcattttttcatgtctgttggctgcataaatgacttcttttgagaagcgtctgttcatatccttcacccactttttgatggggtggtttgtttttttcttgtaaatttgtttgagttcattgtagattctggatattagccctttgtcagatgagtagactgcaaaaattttctcccattctgtaggttgcccattcactctgatggtagtttcttttgctgtgcagaagctctttagtttaattagatcccatttgtcaattttggcttctgttgccattgtttttggtgtttagatatgaagtccttgcccatgcctatgtcctgaatggtattgcctaggttttcttctagggtttttatggttttaggtctaaaatttaagtctttaatccatcttgaattaatttttgtataaggtgtaaggaagggatccagtttcagctttctccatatggctagccagttttcccagcaccatttattaagtagggaatcctttccctatttcttgtttttgtcaggtttgtcaaagatcagatggttgtagatgtgtggtattatttctgagggccctgttctgttccattggtctatatctctgttttggtaccagtaccatgctgttttggttactgtagccttgtagtatagtttgaagtcaggtagcatgatgcctccagctttgttcttttggcttaggattgtcttggcaatgggggctcttttttggttccatatgaactttaaagtgaccttaggtatttttttaagtaagttgttaatgactgctaaacaagaatgtattaagtgggaaaagacaaaatttgtctttatatataattttaaaagttattaaccatcaaaatcttaaaataaatatgtatgtaaagttaaataattctacttaaaattaattaatttatactatgaaaaattatgtaatttctaaaattcctatgggcatgtgaaaagccatatatggccatgaaacgattctgttatttcctaattgttgtggtttgtaggtctgactaagtagaactacatgtggggtgcagaccctgcatttgtccattctttactcccagcataggatgactctttccagtatctccaatttgccaaatcctgtccaccctccaagtcccagttagtatgccattcccctcccctacccactgacccataaggccttgtctgttaccttaggttgttgtttaaaactctcttagggaattcaacaaatcctagcctaaatcatagttatctaggtatacattctccatcgttacagaatcattcattcattcactgattcaacaaataacctttcagcattgttaccatgccattctgggccctgaaaacaaagggagtgagaagaaataaattctgccttaagagtgccatcttgtgcaagcagctgctgtctttgctatatcacatgtatgagtgaatagtgttgctgtgtccagtccagcaaatctgactgcagacctcagtttactgaggctgtttattctactgcctctctagtgtagcctgagactgtaaatttatcagaaagaaattcagcatttcagccttgcatttagtatctaacagctaactgcacttcaaacagaatggcgcttcttttgagaaagaagtatctctcacatgagcccagcattccatgaaccaatgaacgaaagtgttgtttaaacattctatttctccctgaattcttctcttaattaattatgtagctcagggtagtaacaatagtaaggaaatctgatacagccagagttcttttccactaacaaacttttagaccttcttatttatgtttatatttacattcatatatgggagtgagttaattttacaaaatactctgagttcagtgggagtgagaagtgtccatggcatccttgagtaattggggacaattgtttgagtgcttggtgctaactgtaactgtcagttcatcatttatataacaaactcttatgaagatgtctttccacagccagcataaaccaatacgctaacgttggagcaaagggaaaaaaacttttagtagactttgtaaattacagattccatcactattttatgggttggccagttctttcaaagtaggatttgatacagtttacaagttagtatataaattccaaataaaaatgggaaattgaggtcatggaatgaagtagaaagaaaatgtacactggcacatttgatggcactaaacaagtttaactctgagcttcttgctggcaagggcaaaaagagaaaaatgaccagtaactgagatatcattagcagaatggacaacacatatgaatgttctccttggctaacctcctcagttggagattagatggtagtttcctcatctttacctctcagtttgctaaactggatcttcctttccaagtggaagtttgggctccattaagttttaccaagtttcctctgtaatcgaagacagtattgtgtttatagctaataactgggatggctgccttttctcctgaccctggtaatccattcttcagagaacagttagagtgatctctcacaaacagacatcagagcaggtctgtcacatatccaccatcctcccaagactttccatcacacttagcataagtccagactcagactcctatgcctaacccagaggtctccaacctttttggcaccagggaccagtttcatggaagaccatttttccatggaccagggagggggtaggattcttgcgcattacatttattgtgcactttatttctattattataacattataatacataatgaaataattatacaactcaccataatgtagaatcagtgagcgccctgagcttgtttttctgcaactaaatggtcccagctgggggtgacaggagacagtgacaaatcatcaggcattagattctcatacggagcatgcaacccagatccttcgcatgcacagttcacaacagggttcacattcctattagaatctgatccagccactgatctgacaggaggcagagctcaggcagtaatgcaagcgatggggaatggctgtaaatacagatgaagcttccctcactcgcccgcccaccattcacctcctgctgtgtggccgggttcctaacaggccaggaaccagtactggtccatggcccagggactggggacccctgctctaacccacatgaccctacaagatctgaacactgcctcagcttccaactccctttccctctctcaattctactttaagcactgtggtcatctatttctggaatacaccaggcttatttactcctctgggtcttagcacttgctcctccctctgcctcaaaagctcttccctagattttcacatggtttgctttttcatgcattcagaaataatgcaaatgttaaattctcgagaggtgctttcctgatgaccacaaaaccagtctgaacatcacattttatcacattactgggtcttattttcttcaccacacttagcacctgaagtgatcttgatgcctgtctccatttgcttgtttgtctgtgtcatcactagcatgtaaacccacaagagaagttgtgcatgacgtgtggtggtgatgaagaaatcattaatgaaagatatattataaatggattttattattaaaatgtataaaatgaaagagaaatacaaatatatcatagttatttcctttcccaaactatctggttaatgtctacatcagtgaattcacttaatacaggggttggcaattatttttctgtaaaggaccactaaataaatattttaggctttgtgggccatatggtctctgtctcaattactcatctctgtgcttgtagcacaaaagtagcaatacataatacataaacaaatgggtgtgcctgtatcaataaaactttattttaaaaaataagcagccattggatttggcccttaggccacagtttaccaaatgctaatatagcatgtagatcatagttagtaccaagaaaatcagagttgctgttaaaagtaaaaacaaataacaacaaaaaaatcaatgttaaaaagaatccagaacactggagcaaaaattcatatgtataaaaaatgaaacaataataagaataataaaaaaaaccaaatagcagcaatgccaatgtccatatcctggtttaggccacactcccgagcttcactccatggctgtgaaaagatgatcctctctctagaatatgctgatgagatcatacttggaaaaatgtagacaggtccaggcacttcattaaggagaaaatggaaaaaaatgtccaaaaactttggaaagccttcctagtcgctggagtgcattcagaagcatgcagccagaaaggcagcttgggaagcgaacaattgcagaatgattaaaaaggccacaggctatgaaacagggtggaataaaggaagactacaggggacacgtgaaagcatttatgtaagaatgctgcacaagctgcagaaagaggtatgtgctgttcattctatctgaagatttgaaaacataaaatagaatgaaatttggagatacatattggatccaaattttcccaccgagtttagaaaaaaatagtaatatctcttcttttaaagtctctcccagtgattctagaaaatgtttccaagaatatatttacatttatttagcacttcacagtttttaaggtacatttgaacactccattccaatttgatcattgaggcaggcaagaaaaattttactatccctgttttgtagatgaaggaacagaagttcagagaggtgaactgggttggctagtaagtaattgggtaaagggcataagctttggagccatgtagatctgagtaaaattctagcttaagtcattgggcttattactacttaagacagaactttctctgaacacctacatcttcatggactcaatgttacacttgggaaatttctggcttgacatgagatatacctgaagtacatttaaaaaaatgtagctattcttgagcttcacccagaccaattaaataaaaatttctgggagtagggctcagacatcagcaatatttaaatatgccaaggtaccaccaaagttgagaatcactgatctagtacaagggttggcaaatgttttctgcaaagggccagatattaaatattttagtctgcttaccattcagtctctgccacaactactcaactgtactgttccatggcaaaagcagccttagacagtatataaacaaatgggcatggctgtgttccaataaaattttatttacaaaagcaggcaatgggccagatttggcccaagggccatggtttaccaacccctgatctagtagaagatttctatggaaagagacgtctggagatgttaaagacctcatcattcatcaataacaaagtcaaagccaggattctgctgttctgcccactggcctgctgtggtcctactaccagctctctctgtgtcttggacatgctgtgctttattctcaacaagcttaaaacattgctccagaataacatatcaatcatttaatgggaagagggctgcctttagacagagacagccatggttttcagtcccagccctgccactcattagcagaagcagttccctcaaaccctctgtgtctgactgccttcattaataacccagatatgagattccccgcagagaatttctgtgtgggttaaatgaggatgaaatggcctggcaccacagttggcacatggtaattgcttgatactgattccaccacgtgcagacttttattattttaagatgtgctcttttacacttcatgtaaaatattggaaaaaactgaagtcttaggaaaagatatatattttactaaaatttactctcacaatcagagaggagaaggaacatattgaaaaggggatcgaaagaggggtaaaggagatatgtgaagaagctccccaaagagattctgatggccatgcccaaccttaccaccaactgagaatcaccagcctagagtctgaatagtcttccagcaccccagaagttgaaacgagatgaagacagtgcaaagattatatatattttaaatcagatatatgagaaatgtggtgtgggtttgtttactccatcctcctaggcttggtgacttaaatatgaatctaaataccgtaattcattatttttcattaaatataggagacatgttagtcaaagtgtgacttcaggatttagttgacatgacaaaattgatttatactgatatttgtgaatttagtgactttttaaaataccctagggtggtcatcaagctacctatctttccactgaggtttagaagatttctatgtcacatattctaaaagattgggatactaattcctatgagcaggaattgttggttgactgtacaacatccatttccttccttgcttgctaagggatccctatatcattcaaagatttcttgctcctaggccatcatgtgtttcacgtgagggagtctgaacctatcctcagctctacctgtgggcctgattgaggtagaaataatgtatgtcttctcacttgtgattggatagaaaatgggtatgtgaccttattctggccaatgagagatgagaggaagtcacatagggcttctaggacaagtttcctaattcttttgagagggcaacagaagagacggtctctcttctttctttggaaagcattgtttctgtaggcgatgccaagatccatcatcttgcctaaagttaatctgataataaaggtggccatggggcaagtggtatcaagaacttggatctttgttgacatcattatgtcgtggaatcaaccaccctgaacatgctccatctatggatgtttctttatgtgagttaatacctctccttctggttcaagtcaatttgattgagaatatcttggttccaaaagcatgctcctgaagccaaagtacagcatggagtagcatatttgctacatttggtaacctgaggcttcataaggaatgcaagtagtctggcattttgaagattttagaagagacatgttctttattaacaaatttctacggacaaatctcacagctggatggcaatatacccagaagtaataccattaatctttagggaaagcaatgtctttggagttcagaccacttgaatgcacacatatttgccaatcttgtacacaactcaaaattttggttttaattcatcatttcaaagtacaataaaatgttcaccagagcaaccaaataaatgagaaaaacttaaatttacggcttcaaaataatataggttataaattatttctcttagctcagcatttgaacttcctgtactcattcatcccgtaaatacttattgagctcctattatgtgctaggtgtacggaatatagaaataaaaagggcaaaaatcagtcctttaagggaatcagaggctatcagagtcctgtacagtaaacctttctgcaatgatggaaatgttctatatctgtactgtgcagtacagtagccctagccacctgtggctaaagactacttaaaatgttgctattgcaacttaagaacagaatgtttaatggaatttaattttaattaatttaaatataaatagtcacatgtacctcgtggtttccatattggacagtacagtctagatggtaatgcagacaagaaaatcaaaggtgattatatactattatctgtaccacaaaaagagatgcacctggctctaaaaagtaggaatccaggggaacagtgcctaagtaattcagcctggggctagagggcaggataagaaaatatatccaaggaaagcggaccgttaaaccaagtcctaaaggacaaagagaagttaatcactgaatccactttctgtctctatgacattaaagaattatatttgcatattctagtatgtcatgaaattagcatattcattttatgtatacattggagctttcctgaatcacttactctacatttgatccagaaggatttctacttgacattttatgttacatacaaaatattttatgttaatacaaaagcactcatgtgccagtttgaataggatatctacaaacttgtttttgagcacatgctaccaaaataattttatctgatcctatgcatgttttcctctttcatctattctaaatagtggttttcaggttaccattcaaaatacatatctgaaaaagtaaacctccagttatataaatagtatgtgcatggagattcatttttctttctgttgcttatagttcactgagagagtcatttctgactcttgagctctttctgaagctgtgaggtgcacttgtctctggagcagaactgagtgcccacctctgtgaattgattccaggtcctatcataccctgcatggttcctaagcacaacattctgtctctcccaaaggagaggagctgggaaaatctgtgtgtggctctagctggctctagaagattaatggctgaggagtgaagaggacaaatgcaggcaggggtactgctgtggagcagaatcaccaggaggcctggacaatgaggaaatggagaggtaattggatctcaggtgataacaacagaatggacaggtttggggcagagttgaggagaaaatgagagcactactgggttggaaacacattgaatactggaaggcaaagatggtcaaggctttaaagtaggtgactgaacaaatagtgtaataatttgtgtaaaaaatgtggaggatggcttggcttcttttgggagttaggtggggttctgttggattcgaggagtagtggggtatggaaaacacaaattcggaggtcagtgatgccacatttagagagatcactgagggggtaaggcagatgggaaggagagcaaagtaaggggcaagagactagacagggagcaaccacacagaagaactaatgtgcttggaggttctcaggtcttggaagaggctgtgaagcccagattaaggtattgaatgagacagtcaggacagaaagagacctggaatggggatagattgggaaccacacgtccgtgattcacattaaacaatggagaatatgtcccaagagtgccttgctccaggagaggaaatacgatgccatggttaagatcccagcctctgccaccatttaacctgttttggaattctgtctctgtgacttccgggccgtgtgaccttggacaaatcacatcgttttcctgtgcctcagtttccttctttctaaaacagcaatagcaacagtgccttgtgtgtcattgtgaggattaagcgagttaatatatgtagtatatgggagaggcggaagaagggaaatggtctttccgagctggagatcttgaagcttggaaagctttgattactaatggtggtggcagggacaggtatcaggggtgaggtgaaaatggaggcccaggaagtgctggagattgaggaactggcagattagtctgttaggaataacctcaacataaatgttaaaggagagcaagcataaaaaaaagcagaaggaagactaagtttttcttgacaacatttgaaattttaatattagcagatattactgatcaaccagcctctatggttggcagtttatgttcctttacctcattttctgctcatgacaactctgcaaagtcaatgttttctgccttttcagaaaaaagaaattgagactgaagtggtttatgtacaatgccaaagctcccacacgtagtgcatggaaaaggagccctcagaacctgggcttttcgaactacagctatgtcattggaggaaagagaacagctcagctctccaaattgcagtaactgttgagctaaggtgatgacgtcaaggggaaggtaaggaagaatgcagaaaagatgagtttgcaagactgaaagctattcaacattgtaatctgtatttgcaaatctaaaagagaaccagtcggtttgtatcagttcttttgggttcattgcagttaccctctgaactgaggaagctcttttcttttctttctttcttctttctttctttttttttttccgttggagaatagcattatcattcagattggtttgagtgtctgacaatgttttatgtagtcttcttatttccaagcctgaaaagttattccccatgtaatagttccatattccttttggaatgtgtagcatgatatccctccctccctcctagcagcttgtcttctatgatatatgccatttcatccctttagcaattggaaaatgtatttctagaagccagtctcttggcaattggtgcattatccattaaagagaatatccatgcattcactaagaattgcaggtttaaagtgtttggtaataatcgctggttgtttgtcaagcagaatttttgtctgaacatgaaaatacaacatgaatatgatttgcaaccattccacagggttcctaatttcctccagcaacacagagttatttttcttcatgcttaaaatccactacaggtgcttagtgcatttggtctcctttggaggtacatgttctaagtttgacacaggaaaaagctgaaaatgttctaaccaagtaatccccccattccacaatcttttaactctgatttattccaaagctgaaagtattcatcactagttgagctaaaataaactaactcttatgacatataattaaattactggcagaaagaaaatctaaaattcctccacagtacttcacataaacatcagcagcataattgagttgaggtaaaatattttgttgaaaggccaaaaaatgtcacctgaaggaatttgtttccctaatctctgacgttgtttaattttcttcataattaccaaaaaattcactttcatgtaaaatcctcttttcttttagctattctttacctcacttctctttctatgtctttaccagaaactgggaataaaaacattagaaaaatgtttacacttttagctaactgatagtctctccagatctggctaaaagaaattatgcatatactcagtattcacaatttctaagtttaaattctagaaagggggagtgttacatttccgttttgtccatctgggttttcttttcagttgacccaagaacagactcgattatcctcaagactttgtaaccagggcatgttaatttggggagaatagtgatttctcgtttcctaattaaatagccctagggagagggccaaaaattgcctattagaagcagctgtggagtaaggcactcatggagaagaatgaaaggggcaagtgaatatagcaccttcaactgaaatatccaggtgcactcgcattgggactgatcagggaaacaactacccacagagaacgaagaaaaagcagggtagggtgacagccctcccaggactgacacggagccaagggaaaccccacccccagccaagggaagcagtgagtgattgtgcaaccctgggaaaccaccacttctcccacggatgtttgcaacccgtggatcaggagatcccctcatgatcccctgccactaaggccttgggtccaacacaaagagctgtatggagtctcagcagggcaattgctcaggaatgcacagagatcaaggaactttacatagtctgggcccaggatccccaacaaacatgtctgcaactcaggcaaggcaagaggtccatacacatccccaggaaggggactgaatccaaggagctgagcagcatcagtctgcagactccacttccactgcccctctaagacccactggcttggaattccagcctgccactggcaacagggtgaagcctgcctgagatgtgacagttccctcagtgggaggggcagaccaccatctctgctgtttggtagactcagccattccagcctgtgggtcttggagagtctaagctgacagaggcagaggcagttccccagcatgacatggctgttttgtcgagcatagccagactgcttctttcagtgggaccctggtccactcctcctctgaggtgggtcctcccagccagggcctccggccatccctgcccatgttctaaagcagacagagttctcacttcaccctgggaccgagtgcccaagcagtagggcaggctgccacctcagctgtttgggcgtctcagccagtccagcctgtgggccttggagagccaaaactgatcaggggctgaagggatccccaacacagcacagctgctctaccaaaaaagcagccagactgcttcaagtgggtccctgatcccattcctcttgactgggtgagacctcccaacgggtctccagtcacctcctacaagtacatttgggctggcaacaggtcagaacccctgggatggagcttccagaggaaggggctggctgccatgtttgctgttttgcagacttcactagtgatacttccaagtatgggaaaaaccaaggtatgggaaaaaccaaggtgactagggtctgcagtggacccccagcaaaccacagcagccctatggaagagtggccagactgttaaaagaaaatcaaacaagcaggaaaacaacagcaacaacccataaaaaccccatccaaaggtcagcaacctcaaagataaaaggtagataagcccacaaagatgaggaagaatcaaccccaaaacactgaaacttcaaaaagtcagagtgccccttttccttcaaatgaccacaacacctttccagcaagggctcagaatcaggctgaggctgagatggctgaaatgacagaagtaggcttcagaatgtggataaatcaaacttcactgacctaaagacgcatgctgtaagccaatgcaaagaagctaagaatcatgataaaacagtgcaggagctgagagccaaatagccagtttagagaggagcataaccaacatgatagagctgaaaaacacactacaagaacttcataatgtactcacaagtattaatagcagaatagaccaagcagaggaaagaatctcagagcttgaagactatctttctgaaataagacagtcagacaagaatagagaaaaaaagaatgaaaaggaatgaacaaaacctctgagaaatatgggattatgtaaagagaccaaatctatgactgattggagtacctgaaagagacagggagaatggaaccaatttggaaaacatacttcaggatatcatctaggagaatttccccaacctagcaagataggccaacattcaaagtcaggaaatgcaaagaactccagtaagatactccacaagaagatcaagacacataatcatcagattttccagtgtcgaaatggaagaaaaaatgctaagggcagtcagaaagaaaggccaggtcacctacaaagggaagcctatcagacttacagcgaaactctcagtggaaaccctactagccagaagagattgggggccaatattcaacattcttaaaggaaagaatttccaacccagaatttcatatctggccaaactaagcttcataagtgaaggagaaataagataaatgctgagggaatctgttaccaccagatctgccttacaagagatcctgaaggaagcactaaatatgaaaaggaaaaacctttaccagacactacaaaaacacactgaagtacacagaccagtgacactatgaagcaaccacataaacaagtctgcaaaataaccagctagcatcatgatgagaggaccaaattcacacataacaatactaaccttaaatgtaaatggactaaatgccccaattaaaagacacagaatggcaagctggataaagaaccaagacccatcagtatgctgtcttcaagagacccatctcacatgcaaaaatacacacaggctcaaaataaagggatcaaggaaaactcaccaagcgaatggaaaacagaaaaaagcaggggttgcaatcctatattctgacaaaacagactttaaaccaacaaagatcaaaaaagacaaagaagggtattacataatggtaaagggttcaattcaacaagaagagctaactatcctaaatatatatgcacccaatataggaacacccagattcaaaaaacaagttcttagagattttcaaagagacttagactcccacacaataatagtgggagactttaacatcccacaatattagacagatcatcaaggcaaaaaattaacaaaaatattcaggacctgaactcagctcgggatcaagtggacctgataaatatctacagaactctccatccaaaaacaacagaatatacattcttctcatcaccacacagcacttactctaaaattgatcatatagtcggaagtaaaacactcctcagcaaatgcaaaagaactgaaatcataatagtctcttggaccacaacgcaattaaattagaactcaagattaagaaattcactcaaaatcacacaagtatacggaaactgaacaacctgctcctgaatgacttttgggtaaataatgaaatgaaggcaaaaatcaagaagttatttgaaactaatgagaaaaaagatacaatataccagaatctctgggacacagctaacacagtgttaagagggaaatttatagcactaaatatctacatcaaaaagctagaaagatctcaagttagcaacctaacaacacaactaaaagaattagagagccagcaaacaaaccccaaagctagcagaagacaagaaataaccaaaatcagagctgaagtgaaggagatagagacatgaaaaacccttccaaaaaaatcaatgaatccaggagctggctttttgaaaaaaattaataaaacagatagaccactagctagactaatacagaagaaaagagagaagattcaaataaacacaatcagaaatcactgatttctgactccacagaaatacaaactgccatcagagaatactataaacacttctgtgcacataaactagaaaatttacaaggaaggaatggataaattcctggacacatacactttctcaagactgaactaggaagaaattgaatccctgaatagaccaataacgagttctgaaactgaggcagtaataaatagcctaccaaccaaaaaaaaaaaaagaaaaaaaaagccaccaccaaatggattcacagctgaattctaatagagatacaaagaagagctggtaccattcctactgaaaccatttcaaaaaaattgaaaagaaggaactgctccctaactcattctatgaggccaaaacctggcatagatacaacaaaaaaagaaaacttcaggccaatgtccttgataaacatcgatacaaaaatcctgcacaaaatgctgacaaaccaagtccagcagcagatcaaaaagcttatccaccacaataaagtaggcttcatccctgggatgcaaggctggttcaacatatgtaaatcaataaatgtaattcatcacataactgcagacaaaaaccacatgattatcacaatagatgcagaaaaaggcctttgataaaattcaacatcccttcatgttaaaaactctcaataaactaggtattgaaggaacatacctcaaaataataagagccatatatcacaaacccacaaacgatatcatactgaacgggcaaaaaccagaatcattccccttgaaaactggcacaagacaaggttgcccactctcatcattcctattcaacatagtatttgaagtcctggccaggacaatcatgcaagagaaggaaataaatcatattcgaataggatgagaggaagtcaaactatctttgtttgcagatgacatgatcctatacctagaaaaccccattgtctcagcccaaaagcttcttaagctgataagcaaattcagcaaattctcagaatacaaaatcaatgtgcaaaaattgctagcattcttatacactaacaggcaatctgagaaccaaatcacaaatgaactcccatttacaattgccacaaaaagaataaaatacctgggaatatagctaacaagggaagtgaaagacctattcaaggagaactacaaaccactgctcaaagaaatcagagatgacacaaacaaatggaaaaacattccacgttcatggacaggaagaatcaatattgtgaaaatgtacatactgcccaacgcaatttatagattcaatgctattcccataaaactgacactgacattcttcacaaaattagaaaaaactattttaaaatttatatggaacaaaaaagagagcccaaatattcaagcaatcctaagcaaaaagagcaaagctagagacatcatgctacctgacttcaaactatattacagggctacagtaaccaaaacagtgtggcactggtataagaacagacacatagaccaatggaacagaatagagaacccagaaataagactgcatatctacaaccatctgatctttgacaaacctgactaaaacaagtaatggggaaaggatcccctatttaataaatggtgctgggagaactggctagccacatgcataaaattaaaactggaccccttccttacaccatatacaaaaatcaactgaagatagattaaagtcttaaatgtaaaacccacaactataaaacatctagaggaaaacctaggcaataccattcaggacataggcacaggcaagatttcatgacaaagacaacaaaagcaattgaaacaaaagcaaaaattgacagatgagatataatttaactaaagagcttctgcacagaaaaagaaactatcaacagagtaaacagacaacctacacaataggagaaaatttttgcaaactatccatctgacaaaggtccaatgtccagcatccatacggaactgaaacaaattaacaagaggaaaaccaaacaaccccattaaaaagtgggcaaaggacatgaacaggcacttctcaaaagaagacctatatgcagccaacaatcatatgaaaaaagctcaacatcacagatcattagagaaatgcaaatcaaaaccacatgagataccatctcacaccagtcagaatagctattacttaaaagtcaagaacaacagatgctggtgaggttgtggagaaaaaggaatgcttttatactgttgatgggagtgtaaattagttcaaccattttggaagacagtgtggcaattcctcaaagacctagaggcagaaataccatttgacccagcaatcccattactgggtatatactcaaaggaatataaatcattctattataaagatacatgcacgtgtatgtccattgcagcactacttacaatagcaaagacatggaatcaacctaaacgcccatcaatgatagactggataaaaaaaaatggttacatatacacaatggagtactatgcagccataaaaaggaatgagatcatgtcctttgtagggacatggatagacctggaagccattatccttagcaaactaacgcaggaacagaaaaccaaatactgtatgttctcacttataagtggtagctgaatgatgagaacacatggacacatggtggggggcagagaggaacaacacaaactagggcctgttggagggtgggaggaggaagagcatcagaaagaatagctgttggatgctggcttaacacctgggtgatgggatgatctatgcagcaaaccaccatggcacatagctacctatgtaacaaacctgcacatcctgtacatgtacccctgaacttaaaatcaaagttggaaataaaaataaataaatagccctgaggaacacaccacccacctgccacccccccatccccacacacacatatgctactcaatcactctgtacttcaacccattcaggaacttgttaggatgacttcagctttgttttgcttgggagtttgtcctttctgtcacttcaaatttcaaaatgatatggtcatttcagaagccaaaattgcagtgcccacaccacatggaaaatttgtaggccaacactttcaggattcaccacaatatgaacaacaagtcaacacaatggtggtttacaaggcaataaatttttccttcaagttttcgtggtaccattttcatattaacttctaagtttgaaaaattctcttaaccacctcctcccttttcctgttgaacaccaatttttaaattatctggtggtttaataaacttctcttatttttccacactctcttcaactgtgctagtatttttcaggctacttttctttctaaatgcagggggcagggagaaaaaaaccaaaaactggacttgaattggaaatttgggattggcctcaactctgtcatttattagccatgtgacctgtggctggtcctgtgatgactctgagcctagtgggctcatctataaaacaatgttataaatacctacacaagtggaggattcaaaaatatggtacaaagcttgtgaagaagctttgtaagtgccaggaggctacacataggtaatttttattcagaggcatctttgtgacataaaatatctggcaaaagaatgcattggctttcttcttctcccactaggaagaaagagcactgtctcaggtatcagcactcactgctgtaattacaaatgtcttcccactctgaactccagaaaactctcctcacatttcagaactatcccaggcctgctctcaagaaggtaactctactcctactattttgtagcccatagtctactgataacatatccatatgccttcatattctctaatgtctctgccctttgccttatcctcaaggctctacctcccttgccagcctttccgaaggaagtttgattgctccttctcacacttcccatgacttggggatgggattagaatgactaggaggagatggaatagtccctactttcttctatagcttttaggttcctgccccaacatcaacatgctataatgttcctagtttgtgtgtgtgtggggggagggttgttttgttttgttttgtcgagacagggtcttgctctgtcacccaaactggggcacagtggtgtgatcacgggtcactgcagccttgacctcccaggctcaagtgatcctcccatcttagcttcctgagtagccgggaccacaggtgcataccaacatgcccagctaattttgtaatttttttgtagagatggggtctcattatatcacccaagttggtctcaaactcctgggttcaagagatcctcctgtcttggcctcccaaagtaatgggattataggcatgagcactgagcctggctctgttcccaggttttaagacttttgtcatatacttacacatctctcctttcccatttattgttgttccattttgagacacattgccaggtgttttaagacactaggcatccactgccatccttcttttcaaagacatcatcctccaaggcactgacaaccctactgatgccccttctgacaccacagttcacagatccttgtccttcagtgcactaaaaactcatctctttggtacttcccctctaaggaagcattacaatatacttgaccatttcatgtgactaagatctcacaccgtgagatccctctaatagactacaacctcctgaacttcccaagctttcaaatcctaattcctgctgcatctccttcctcatgctggcatccacttcctggatccctccctacttttctagtggattgccaactgtggtccaatgaatagtgaccctcccaaaggtttccacgtcttaatccttagaacctgtgaatatgttaccttacatggcaaaagggatttgcagatgttattaagtttaggatcttgagatgaggtgattttccaggagcccaaagtaatcgcaaggattcttataagagggaggcaggaggatcaaagtcacacaaggtgatatgaggatggaagcaaagactggagtatgcagctgtgaaccaaagaaagtcagcagcctttaaagctgggaaaagcaagaaagattcaccctggggaagtaggggagacctagcactgacaccttgatttcaacccagtgaaactcatgttggatttctggccttcagaactcttaagatagtaagtgctgtataagccatcaagtaggtggtaatttgttacagcagccataggaaactaatatacaaccatagctgagtggcctcttgactcagttctgaaagagccaatggtcaataatttgtttttcccttcaccctagaattcctcttgccaattcccaactgacttctattacaattatggaacttttcattcctacacatctgtttttgagtgatgttagagcagaccttaaactaattaggatcatttataaattactgaattatataaatctttttccttgaagatttctcaccagtggctcagtagtagatgctgaaaatatttctactctgtctgggttaccaaatccacctccacccacttcagtcttcaatgaacccaccttctctgacaaaactgagataatctacaacctttcaacttttcttctatctatttttagaactgtttttaaaaatataatttattttttctttttaattgatatataatagttgtacatgtttttagggtacacatgatattttgatagatgtacacaaaatagttagaagagaagactggaatgttcccaacacaaagaaaagataaatgtttgaggtatagatattccaattaccctgatttgatcattacacattgtatacatgtatcaaaatatcacatatacctcttctgcttttaactgcctcttttcttccctcttgtctcaaattcagtgccctttttccttctcagctctatgtacgtcctttccatatcccctagatcccatgccattctgcatcttcctgggtctcacaccatctattagcttcaatcactggggtgcataagaaggagtcttgtgcactgggagctccactcccaggttcagggaagcactacctaagccatccaagataaaaatcattctcatgttgtttcctaagatccccaaagctagatccatagcttgtttctttttaccatattttcttgccttaaatataaagactttctcaagttgaagagagcattctattgttctgccgtttggagacacacaggaaaaataatagacacaatgacattaataggaattctctaagatcatgtggattgcagatattctataccactgtctccataaatataaaatgacccatttgttttgttttgttttgttttgttttggaaattagagtcactcttcccatgatacttaaagaactgtgccttttgggtaatagacactcactaaatattattgaattaaatattcaaaatagctcattgaaatggacatttttcatgagctgcatcatcatgggcattggactcttaacccaaacagctagatttgccttcaggtaagaatctctccatctctgtccccataaatttgttacaaaataatatattcatcagtgtataacctttaccatgtggcttcccactgtgaaaacagaattaggtgctttttactgctgacactaatatatgcttgttataggcttcaaaaatgtcatgtaatagttccaaaaattttcgctggcaattgaagcccatggataaagagaaagaagcataaaagggaacagttgtgtatatatatatgtgtgtctatatatatatacataataactgacattatgttgatgttaaagatgtcaacatttttggggaaaaatattgcttattttaaaatgtctaacattattctagccaaataaataaagaatcaagctcttgcagaaatataatccttttgaaaaaggtatagattttttcgtatagctattttctttttgcttaaattaattgcatttgtatgtaaagcacacagacctatatttaaaaagtgtattatatatactaaccttctcaaaatttatattttcaatctgtgaatttacatatatatgaaatatataaaccatttcaatgatagtaccagaatacattttaaatcccaatttatgaaaatatcttaaagaaattatgaagacatttaaataagaaaagcaatatggagtactgagaagaaagtacatgtttgagctaatccaacctggatttgaaccgttatcactcactatgtattatttaataagttcaatcccattaataccaaaaatgacatataataatattgtaattctcatcttcctcgatgttatggagcttaaatgagtcacagcctttccaaaaacatggatttcttttcttccttctgtttaagaactgtatctaattttacccccaagcgtgcccaacacaatgctttaaataaagtagatattcaataaatgtttactaagtcaatcaatgtcttgcaaatcacttggcaatgcacattatctattttcctccacactgagaaaaaaccttcatagataaatcaagttaatcatttcccttaacctaagaactacacctcaatttctttcagagaaccttacattttgagtctctatgagtttcttgtaaattatgtcttctatggggctcggcaatcaagtggctaaaaagaaaagagatgccaaaatttaaggaaaaggaaaacacatgattttagccatggtattgcttcagaaggttttatacacttgacctttgataaacatgttttttctcccaacagctattcctgattttactccaaggtggctttcccaagaccagaaccagctcatgaaaaaagagcccaatcaggaaagggtggttagactctaatcaccctgggcagtccctgcctcttctccttggtgctcctcattcccctgcaggtaccaaccagtcctttagcatccttacggggcccctctctaggatttggggagtgagtgaaagagttggcacatcccagtttacggagggcagaccatgtgcaggggcttcacaaacatcatcaactttcacccttccagcattcctgctgggagaccctccttcattttcagaagagagtcatttggggttcaaccagtttcaataaatcatttgcccacgtcacagaaaaaggaaggattagacctagttttctttttcttaagatacatcatatatcatacaacttgcccttttaaactatacagttcagtggtttttggtacattcatgatgttgtgcaactatcaccactgtctaatttaagaacatttttatccctctaaaagtaaaccccataccttttagcagttactccttacaacaccccaccctcagtcttaggcaaccactactttctgtctgtatggatttacctattctgtactttttatataaatggaatttcatattgtttttgtaaaagaaaggagtaaactaggatatattttatatatgtataaagaacctacagaaagatattttagtccgtttgggctgctaaaaccaaataccttagactgggtaatttataaataatagaaatttatttctcacaattctgaaggttgggaagtctaagatcaaggcactggctgattggtgtctggtgaaggcctgcttactggttcatagacagggccttctcgctctgtcctcatatggtgaaaggggtgagggagctccctggggtctcttttataagagcaccaatcccattcatgaggctccgccctcatgacctaatcacttctcaaagtccccaccttcaaataccatcacattggtattaagtttaaatatatgaattttggaggtacacaaatgttcagtttatagcaatgatggaaggggaaactgaagagattccaagggtaagaggggctcaacccaccactgtcggcaggggccaggggaaagcaagagaaagaatgtaggcagctgctgggagcagagtggtctgactgacagccagcaaggaaacggggacctcaagcctacaaccgcaaggaattgaattggctaacaacgccaaagaacttggaagtggatttttctcagagtctcctgaggagagcctagttggctgacacattgatttcagccttgtgagcccctgagcagagaaatcagccaagccaactcgacttctgacttacagagcagtgagattttgtgttgttttaagttgctatatttgtggtaatatgttgcagcagcaataggaaactaatacgcacctagctgtattatttgtcttcttattataaataaagattgaaagctagtggaaaaccaaacagactatgctaacataattgagagtaaggctagtttcctagtgacataacttatccagtcaaaaggtcatgatagtttttaaattttgttttgcgcacctacgcttgataattttagtctgaaaattgtaattttgacaaaaatctccagggaagcaaatctttctagtaaaacttgaatggcaggcttattaacccaatgttctctgtctcctaaatctagagccttcccttaatactaaaattccaggatataaacatggtttctttcattcttaagaagttgattaacaacatgccccggtgtgtgatgttccccttcctgtgtccatgtgttctcattgttcaattcccacctatgagtgagaacatgcggtgtttggttttgttgtggggtggggggaggggggagggatagcattgggagatatacctaatgttaaatgacgagttaatgggtgcagcacaccaacatggcacatgtatgcatatgtgactagcctgcacattatgcacatgtaccctaaaacttaaagtacaataataaaaaaaagaagttggttacaactgataaaaattaaattgatagactctaaagagacagacacttggcttaaaggagaatgtttgccttgtctatttgaaatgtctaaaggttaactctgcactttatctaacctttaaccatacagtttttccttttggtattgggtatgttccagagcttttctaaaggagtttaatgttattacatggggaaaatggtcaaataagtggtctttaatacagaattaagatgaaagttctaagaacaccatttctcttattatcatttagctctatatggctaagtactttgtgtgaaaacaaaaacagttcaaaattgactacattctatgagaaaaagcagaaatatttttcctacctaatttgttggaaaagcttaattaatttattttattttattttattattattatactttaagttttagggtacatgtgcacaatgtacaggttagttacatatgtatacatgtgccatgctggtgtgctgcacccattaacttgtcatttagcattaggtatatctcctaaagctatccctcccctctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcattgttttttatggctgcgtagtattccatggtgcatatgggccacattttcttaatccagtctatcattgttggacatttgggttggttccaagtccttgctattgggaatagtgccgcaataaacatacgtgtgcatgtgtctttatagcagcatgatttatagtcctttgggtatatacccagtaatgggagggctgggtcaaatggtatttctagttctagatccctgaggaatcgccacactgacttccacaatggttgaactagtttacagtcccaccaacagtgtaagtgttcctatttctccacatcctctccagcacctgttgtttcctgacttttgaatgatcgccattgtaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagcgtttttatggttttaggtctaacgtttaagtctttaatccagcttgaattaatttttgtataaggtgtaaggaagggatccagtttcagctttccacatatggctagccagttttcccagcaccatttattaaatggggaatcctttccccatttcatgtttttctcaggtttgtcaaagatcagatagttgtagatatgcggtgttatttctgagggctctgttctgttccattgatctatatttctgttttggtaccagtaccatgctgttttggttactgtagccttgtagtatagtttgaagtcaggtagcgtgatgcctccagctttgttcttttggcttaggattgacttggccatgcgggctcttttttggttctatatgaactttaaagtagttttttttttccaattctgtgaagaaagtcattggtagcttgatggtgatggcattgaatctataaattaccttgggcagtatggccattttcatgatactgattcttcctacccatgagcatggaatgttcttccatttgtttgtatcctcttttatttcattgagcagtggtttgtagttctccttgaagaggtccttcatgtcccttgtaagttggattcctaggtattttattttctttgaagcaattgtgaatgggagttcactcatgatttggctgtttgtctgttattggtgtataagaatgcttctgatttttgtacattgattttgtatcctgagactttgctgaagttgcttatcagcttaaggggattttgggctgagacaatggggttttctagatatataatcatgtcatctgcaaacagggacaattttgtttcctcttttcctaactgaataccctttatttccttctcctgcctaattgccgtggccagaacttccaacactatgttgaataggagtggtgagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtcgttggttctgtttatatgctggattacatttattgatttgcgtatattgaaccagccttgcatcccagggatgaagcccacttgaccatggagaaaaactctacgaattaatctagctgttgggtaaaatctacttatttttaacatcatctctcctcttctaagacctgtatccacctcttgctacccactgctgtcaatatttatttcagtagttctcaaccaggggagattttgcctcctagggcacatttggcaatgactggaggtgtttttgactgtcacaactgggggtgtgctagtcaatctagtgcgtagaggccaggggtgctgctgaacttcatacaacgcacaggacagccccttctacagataattgtccagcttccaaatgacaatagtgccaagtttgaaaaattctggtttagatggatctagagaggtgggtcagtaatgaataaagatatggagttctccatttaggacaattaatgaaagccatgttagtacaggattgttgtgagagagggagagggatagggagagaaagaggtttgacaaatgtctatattaaactatattaaagtaacagaaagagagaccaaaaagtagaggcaaaaaccaagtgatcagagaaataggaagataaggataacagagtgtcacaaaaataaggagggagacaattctaaggaagacttggtcagcaaggttgaatgctatggagcaggagtgttgaatgagcacgaaggaaacaccatgactttcatactaggatattatgggtgacctccaaaatataagctttaagtgaacagtgaattttggagaagagttcaaggcttgaaggaatcggaacagatgcttttttttttttaatttctgtttatttttgtttgttctattgcctttttaagacagaaaaagatggagaatgtggttatgctgacaaaaccaccaccaggcaggataaaaaatatcattgtgctaaaaattatcctctgaaataattagcatttcaataaaaattttaatttttttcacaatttcaagcaatcacaacatttaaagaggcatatatcatatatgacatttaaagggagatatgaactatcttgtgaaaaacgagacataatttaatacaaagaagatactcttcttccctccttgttcttcttatacctagttgtaaagtccagtttatgcaacatacaacaaatgaaagttaattggatctaaacaattagtcaactggggtgaagggactgcaaagaggagagcattggttataatgctctcggcatgatgaccaccagttggtaaaccaatttggtttctgcacttttcagctgattttttctgaatagtatagagaggttaactctgattttcccatttgaaaccaaaatggatttgacatcaaaactatttctttaagtaagccataaaaataatctgttcaactgtctgcctccttcatgctgggctgctggttgccatgctggactgcgaactgtcatgccaggcttgaaaagccattacttcacataaaacccaggcccgcccccatggtcccacatagctcttgatgggcatgctctgtggctccttggatcaggcctgagagctggaaagtcgctatggagcagcagacagagtcaatcaaacgagaacttcctttgggcaagtgcaactacaggaaacaataatagacttcagatttctgggagggattcttcttatccagtctcttaaaaacagaaagcttttctcagacccttaagtgaatttagttccagctttctttcagctttgggttggagagaatgtagctgagtaataactaacaagtataatgcattcactctcttcaaagcctctgccataccattttaggggtagaactgaagcccaaagccatgtgcatttcagcccctgtgagttggttagctccctgtgtcacagtgtctcatcctaagtcagtttatatgaagggttgtggatagaacatcatattctttgtataactactggaaaataaagacgccctctttctgatgtgagtcctatagcgtcttgcatgaaaaagagaacattatattattcttggtgatcagaatagatgctatctagaagatactcacctatacaattcgatttccaattcattagtacgtgagctggctaccctgccatgttcccccactggttctgcaagtccacaaccctcagtctgtccatccccctcttccccttccatgactttggcatgacacacacttatgtctctctaactcctcccctactaccaccttgcccaacacttcagagcagcaccccaggatcttggcatttaagttgtgaaaagtcaccaggcttaactgtatcaatggccctactgaatgctcatacaaataaattatggtttagtgtaaaaaaccccactgcctttgtaaatgctgcagtaacactcattacatcagaacagagccaaagaaagaagcttagatttaatctgttttaatctcagttatttcctaatataaaagactgtgggcattttcacattctttggaaggattagcgaaggccaacatgaataacaaattgacatttctgaagttctggaagagccaaaagcaatataaaaggaaggcagacagatcaaatttctgaacagaattatttttcttagcagagtttaaaagttaacattaggaacaaatgttaaacagctctgcacagttatttatctttacctggaacacattttgccaaacagtttaactgacaatttagaaagacatatcttcatgttatagagacaaagaaacttcttctatgtgacaggcataataagagtttttttagagtaatctgtataacaatttttacattcctctagtcattttattgtctgaaatattccagaactaatgctgccattttttttttagtgaagagtatgttggttcccatgaaatcgttgaatatttgtgttaaaagagatttaaagaaaagtaatctacttcagcttttcatttcataaatgaggaaagtcaggctaagaaagagtacccaagcaaccagtgtcataaaatcacagatctatgacagttcaggcctaggatcctggttttctgatgactcatccaatgatcttttcatttatctttgtccttttcctcaagaagattatattttatcattatatagtattaacttgctccattataaccacattccaatttgctttgatgtatcttaaatcaaaatagcaaaaacaaattgactcttgtggctctacttgtcttaatgccccacaaagtcactgagaaatgctgtgagggttgggtccatcccagcccttggatatagatattttcacatgtaacagaattgtgaaatgaaaagatttctaagatattagttctacgataggattctaaatcctaacacattctgccttccctcttagtcctagacatagggtttagtccaaaccagggtttctcaaccttaccactattgacttttagggtcagataatttttgtaggtgagtatcaacctgtgccttgcaaggtgcttagcagcatccctggcttctacctactagatgccagtagcaccccacccctaaattgtgacaaccaaaaatgtctccagaaattgccagaagtctcctggggtgggggtacaaaatcacctcaaattgaggatcattggtctaaaccctttagcacttacataaaccttgacacaaaataggagcaaagcagagatgaaaagtgggatacaaaggaacttactggcatctttgactatgaaccttccttgactctaaagccaattaaatgttttggtggaaaaaaaggaaagttgttttaatcaaccatatgcctttcctcactcccaccacacttttgccttaaagtttgtttttgttgccatgaaaacagagcctgcctgtttgtaattataatattattctgcagcaaatttcagaaagcgccaattggtacacttccaacctcaaattctctccctcttcatctcccttccctagacaggagtttagagagggggaaggaatgagagaagaatgcctggtatcctcagctctgacctcctaatgcctgcactcagcataaacctctcaggtctccaggacctggcaatcaaaccttccaacacggccttgtctctgactgaacttcatttgttcagcattttcacccaaaaccacagaactttgataagagttagtcaggactcaatgatggtgaagaaagggaagggagaggtaagacaagtagacccatgagaatcaatttgttcttgctattttgagtgcagatacatcgaagtaaattggaatgtggttacactggagcaagttaatactatacaatgataaatacccattcttttttttttaattatactttaagttttagggtacatgtgcacattgtgcaggttagttacatatgtatacatgtgccatgctggtgtgctgcacccactaactcgtcatctagcattaggtatatctcccgatgctatccctcccccctccccccaccccacaacagtccccagagtgtgatattccccttcctgtgtccatgtgatctcattgttcagttcccacctatgagtgagaatatgcggtgtttggttttttgttcttgcgatagtttactgagaatgatgattttcaatttcatccatgtccctacaaaggacatgaactcgtcattttttatggctgcatagtattccatggtgtatatgtgccacattttcttaatccagtctatcattgttggacacttgggttggttccaagtctttgctattgtgaataatgccttttttcaatttttatttttgtttttattttaagttccggggtacatgtgcaggatatgcaggtttgttacataggtaaatgtgtgccatggtagtttgctgcacctatcaacccatcacctagtataaatacccattcttaatgaaaatgagttatagtattattttattcatagcctgtgttacttctctgaatatgtcagtaataaacatgttgtagaaatttaatagaaatatctaatagatgtcgttataaacatgctgtagaaatttaatagaaatatataatagatgtggttcttacataatttcttctctggccttttacagcttgagatataatttacacacaataaattgttcaaatctaaactgtaaagctctataaatttttgcatatgtatatattcatggaactgcttcccagatgaagatatagaacattttcattatagaaagcttctcctgtttccatctagttagtatccacccttacctcccgggcaagcaatattgtgatttctaccaatgaaagaatagctttgtctgtttttttatcccataaattaaattgtacagtatgtactctttgtgccttttgaggcacatgttgaagaacatgagaaacatgttgagtttctaaggttcattcattcagttttatgtgccaatggtttgttcttttttgttgctatgtagtattcctccatccaaataaaacacagactcctgttgatggatatttgtgcctgtgtatatgtatgtgtctatatggactattatgaataaaaatgcaaagaaaatggggtgtactagtctttgtgtggatatatgcacttgtttatcttgggtatataactcagaataaaattctaatactaaaaatggaaaatattaataatcaaattgaattttttatattgctataaagacttgaaggacacaataatcttctcccatttattttacacaaagggaaaatagataaaccttttaaataattaatcaggaaaatatattaaggcagatgaagacatagaacacctgacagtaaggtgaatatagaatttttcatgaaactgggagactttctgagtgaaaggggcatgatcaatatttatatagggactgtttaacctggactttgctgaaaatactggatcttatggccattcacgctaattgtgactgagaagatggaaactaggccagacatctaatgccaacttcagaattaaccccctttttgaccttggtcaacttgtttaaacctttgtcctttaatcatggcattggtcagaatattctccgctgaaattttataaagactccatgaatggcaagtcataaatcataaacctcaaagccaataaagctgtcctgcaaggattgagagctggaatgcagacttccagggttgagatgtatgctttcaagagcctggttgcacctgcttctaaagtgccactcaattaatttatgaggttctctcttctctttcatttacttttccagttgtgacttaaaataagtttcagctagccacatatactctatgttatttcactgaaaagatgtgaactgcaaattacatcagtgattgagacacatttggcaatatctttcttcctcatgcttcagtcaactagacttactgtgtgatgagaatcccagaggcccagggcgacagcccctgaaattttcttttttttttcttttattattatactttaagttttagggtacatgtgcacattgtgcaggttagttacataagtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgaatgagaatatgcggtgtttggttttttgttcttgcgatagtttactgagaatgatgatttccaatttcatccatgtccctacaaaggacatgaactcatcattttttatggctgcatagtattccatgctgtatatgtgccacattttcttaatccagtctatcattgttggacatttgggttggttccaagtctttgctattgggaatagtgccgcaataaacatacgtgtgcatgtgtctttatagcagcatgatttatagtcctttgggtatatacccagtaatgggagggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcactgtggttttgatttgcatttctctgatggccagtgatgatgagcattttttcatgtgttttttggcttcataaacgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtacagaagctctttagtttaattagatcccatttgtcaattttgtcttttgttgccgttgcttttggtgttttagacatgaagtccttgcccatgcctatgtcctgaatggtattgcctaggttttcttctagggtttttatggttttaggtctaacgtttaagtctttaatccagcttgaattgatttttgtataaggtgtaaggaagggatccagtttcagctttctacatatggctagccagttttcccagcaccatttattaaatagggaatcctttccccatttcttgtttttctcaggtttgtcaaagatcagaaattttcactaagtcaaataccatgaaattgtttcatcgagctgacacttgacattggatgaaagggggttggcattacctcctcaaagttgatgttcttaggctcacgtgggacaacaatgctttatttctaccatgtttagaagttttaaggcaacataagataataaccacaaaacagcaatgccatttgagaaggaggggctgcaagtttttgcaggcatttaaaactacgtttgtcaaaaacaaaaagcgaaaagatagaaaatatgtctcttgcaagggaaacaatgtatactggctacctgtagaatgtccccagagtcactggattgaaataattagttgcaaagaaagaataaatttaggtaaaataatgataatctgatattaaggacattgtgtttcctactatagaaaaacagcctttccaagcgaattcattgggagtcataatctgttgcaaaattacaagttagaacaaggactaaaaatatagcataaaatcagaaactaaaatactatttataacatgaattattttttatttacttttaaaaaattatggatacataatagttgtacatatttatggggtacctgtaccccataaattgttacatgtataaccatacatgtaatagttttgatacaagcatataatgtataacaatcagatcagagtaattgggatagccatcatctcaagaatttgtgttaggaatatccaattccattcttttagttattttgaaatatacagtaagttattgttaactattagcaccctattgtgctactgaacactagatcttattccttctatgtaactgtatttttgtacccattaaccatcctgtctttaatccccctcatctagaacatgaattctttgttgataaatttttgttttataaaatcatcattatcttactgctaagttaatatattcaaagtatgaaacatttttcactgagtctataccttctagatttcaaatacaaaaatgtaacgacattagttaattttaaaatatatattgtattttatataaacatatatatttttaagtttttaaaaatccacgtctgtttctaaatctgaacacatacactcatacaccatacacagtcttcttcctaccttttgagagtcactaccttctgaaaagaacctttcctaatgtaaattttcataagtaaagaacaaaatcaccattaatatcaaatggcaaagtttttatacatttccgatgcccaaattaaacctatttatgctaaagcaacaccaagtcacactaaaatgaacccaataatgtcaatatttatcataagttgttataacacaacataacaaggaaatagccctttaattcatcactaacatggttacctatctgcatatgttccgttctttcctagcagttatgtatcatgcatatcatgcacgtaagcctgtgaccataacatgtgcatttgaccatcaatgtttaagtaattgtacttttagttaaaaaataaaacaaatgaaactatcattgataacaatgcaaatgcactaagatcatcactattccaaaccagcaaaccaggagttctcttggaggaagagatggcaagaagcaccaactgcttcgtgcctgttccataaaacattggccatctattttctttgggccaaccaatgagcattcaaatgcccttccatctgtcctctaccaagtccagtcatcaggactgggtcattcttctctagtgttctttaaagacagccaagcggacacaggggtgctatctgcagagttcggtgaggacctgatcaaagataaggtgacttatgaagctgtcccatattaagaggtgtctagataagacaacagagtagaggaacaaaaatataccattttagttagagcaaaagtatctttatctgtgtttgtgttaaacacatatgcatccatgtgtgccgtgatgcatctaatcacagttggcaaagtgttgcttagtagtttgctgagctaagagacttggtgtcactgggagatagtgaagccaacaaaaagagtgtaatgcttcctttgataaagataattcatctcatcccagtgagtctctccttttgcttgggatgcccaaactctccaaggaaggagtggaaagcagagaaaagatgagggagacaggaaaccagaacaggggagacacagcaacctgagacaaaaagttaaaatctatcgaggatgggaattagagagttgcaggtattggcggggcctcagatacttcccactctaaccatcgttcccactccgaaggaagcaggaaaaagagcacaggggcatcaaccagacctgcctataaactcctcccatccatcctcagggccaccattttcacccaggctctgtctagagcccaggtggcctgctcaactccgctcactttgtacatgggtctctgcatcctctctgaaaaaagtcaggtgctggtctgttgaatgtggctatagaaggtaatgacgaagtattcatggagatgaccagacaagtggagccttcttaagaggagatgccttaggactgggatcccgtaatctgtggttttcagccaggggcaattctgatccctgggcaaccttgagcaatgtctggagacatttctagttgtcactactcagggtaagggaggatgctactgacttctagtgaatagaggccagggatactgttaacatcctaaaatgaacagggcagccgccacagccaagaattatgtgcctccaaatgtcactagtactgtggctgagaaaccctggactaaaagaagccaaccctaaaggtcagcttggtgatgcaggagcagccagattacatggctaagagggacacagttggacagagtcagacgcaggacatctctgggcttcagaaggacttctaactcaagttgatgaacaaatgagaagtcagaattgtgttgccgaaacgtcggaagtttcaaagtcagaatcaagattccagcaattacttgatgtttcccagtcttaattttttcatctgtaagactgggatcctaacattgctccataggaatttgctaagactaaagaagatattgaacatgaagaacttctcaccagtgattggcaagtaataggcacttcacaaagagcacttctcttccattttcttgctctaggtaacctctggaatgaacattacagagatagagcaaggaagtggatggttagatcttttccccacagcccgactttttcagagctccttgatcttccttccttttgtaattttttctttctatcccacctccttctaagaactgaaatttcccatccatcagtgatcacatactcaggcaagggcttgaggtgtaacttttttcaccttgtgactcatgaagatacagtagggtgatctcaccaggaacctatgcacataagagactaaagagcctcatagaaaataacttatcctggaagaataaaaagtcaacaggaaaagagtgtttcaaggacaacaggtaacctttgaaagaaaggggtcattctaagcacagcataagcctcatcatgaattcaccctgaatctctggacaaggaaacattaaaaaatacctattaagaaccaaaattgtttctgcaaaatttctaagggccactgaaagcacaaatattattggatttataactatgagggagaagctggcattggtggagactttgcttatgagggctgcccactttattctgacaacaaagttggtgatatggtggcctctatccacctctattcaccttgacagaacgcattggttgcaactgtagcagcaatgctgttgagagacatctgcagtggaagtattcccttccattgcagatggaagtaatcaaatttctccccacagagactcacaggaggggaagaaagaggtggtatattagtccgttttcacactgctgtaaagaactacctgagactagataatttatgaagaaaagaggtttaattgactcacagttccacaggctgtacaggaggcacagctggggaggcctcagaaaaattacaatcatggtgaaagggcaaaggggaagcaagcaggtcttcacatggcagcaggaaagagagagagtaaaaggggagatgctacgcactttcaaacaaccaaatctcgtgagaactctatcatgagacaaaactaggggggacggtgctaagccattagaaaccacccccgtgatccaattaacttccaccaggccccacttccaacatcaggaattacaattcaacatgagatttgagtggggacacagaaccaaaccatatcaggtggtgtgcattcccacagcatggggaggacacatagagtaccatgggcacattccctggatatccccaagactatggagggacaacttgagcagtggaggcagagcagccagagaaacacttttgggggttgccacttggcattcttttcttactcaaacagttatggcacaagttacagtataagagtaaaccattattctctcagaacacccagtgggtctgctttcctgttgctaaaaatcctaacaccaggtttcagcagtaacaataagatgttcactgtgtccctggggccatgcaaatactgcagagccttaactttagctcacaaacctttgacaggccagatccactatagcacgtgatggtgttatgggtagggggagggaaattactgctcttacaacttagctgatcctcaattgatgcttctaagttgctgtttcctcacttcccccactaaaattaatacattaagtccagatctttctgcttagggtaaggaaaagtaaagctaaggctgctcgacttgccttacggtatgctgtgagacaaacaagagtccagggtcccttgctcaccttgaccgtcactgcctggcccttggaatctatacagtgtaaataaagatctgagggaaaaaaatcctggctctctgtgatattttagaggaatgcaaaaaattagacctaaggcatttgcattgaaactcttacattccattatacatatctgaagctcttttgctggttctttatgtctttgtggacaggatgttaatcttaaatcaagattgtaaaattaaacaattttaaatatatgcatgtttaactaaaagattttagagattaagaatcatttgtaaaattagattttacacgtttgatttaagaacatgtattgaatgttagccgtcaagtccccaaatccattcatttgtagatactaaaggatcccaagaggtgagttgattctagcccaagcccaattaatcctgactctaaacattatatgtgtatttttattgagtgcttcctatatgttggggtactgggcaaaaagctgtttgagcactgtatctaatatgtctgcaatatttccctcttcactgtggggaagaaatgtttcactcttctcttaattttcatatatatgtgtgtatatatatatatgcatctgtaccacacttccctcttaattctcttatatgtgaataaatacatatatttatatgtgtatatatgtgtgaatacacacacatgcatttatatatacataaagataaatggcacctaaagtatggcgtcagtgttcactccagctcattgattcccgtcggtttgtagggccaatgtcaagtttttcacgaaaacaaaaaatttctgaacttttaatttaaatatccttgttatggtctgaattatgtctcccctaaattcatatgttgaaatcctaaccccagtatcttagaatatgactgtatttggagatagggcctttaaagaggtaattaaggtaaaatgaggctggtagggagggctctattccaatctgactggtgtccttataagagaatttttgggacacaaagagacacaccaaggatgtatgcatacagacaaaagaccatgtgaggacacagcgagtaggtggccatctgcaagccaaagacagaggaatcagaagaaaccaaccctgccgacaccttgatttcacacctctggcccccagaactgtgagaaaataaatttctgttgtttgagctacccagtctgtggcattttggtatggtagttctagaaaatgaatacgctctcgtttttgaaaattcaggtttttaacagcactgtgtaggtcaaacaaaaacataactaaaatgaagaatgaactctcatacataatgggagtgtgcataaattgcttcaatctctatggagggtaacttggaaatatctatcaaaattaaaaatgattatttttgagtcagatattccattcctaaaatatttatcctgcagaaatattcttgtgtgtgaagtaatgtgttcaatatttgttgcatcatttcaatacagcaaaccacatacatgcccactgatatgggactagtaagtaaattatagcacacctatacaatagaattatgtgcagttattttttaaatgaggtagctctatatagaatgattttacagatagagtgccaagttaaaaagtatcagaactgtgtgtgtgtgtgtgtgtgtgtgtgtataaccatttgtgtgaaacaatgtgtaatgtgtttcaaaatggcccctcaaagtgggatgtgaaatagaaaaaaatatatctgatgctgaagtcagggttttttaccatgaccttaaggcatttattagggataccacacctatacccaaccaagatctctcagcccatttccagatgggcactcaaatttcttagtgcagttggagccctgccctacacagctaagagaagctgtgatcatcagacttcatgacttctttttccctgggcaggcttctactctggcctttcctggcccctccctgctttgccactaaacaccgcctgagatatggacagcctacccagaatgaactctccctttgtgatgtctccttgggtgtcaacaaatgggctactactgtctccctcttttgaacaaaggctctctatggcctggttagagcatttagcttaggaggcaagagtattccacggagcacaacaacctcattatttatatgatcaactaaatcttacaagtgctgcatacagttgcatactcacaagcacattagcatataaagtctctgaagtctccgcggtgtagaaaagtggttgccctttttcatcccacagttgcccaagattatttaactaatgaatcttctctctttgttgcacatctatgcacatcatgtaaaactagtatttcccagtgtgtaacacacttgagaaaatctcttctaaaccaagcacagcttccattcttttctccagcttgctctttatagaagagactcaaattaccttcccaaacaaacaaggctccaaggattacagctaacaacaaggataaaacaacaacaacaacaaaaataagactaaataggagagggagagaaacccaataaagaggtaaaatttaaaattaaacgtcaaattttataatttgatggttctatttatttctgattaagaaaagaaacctgatcatggaaagttataaattagaaaccaggaggcaagcaggcaggagaatagacaggaatgttgaaggtcacagcaggcaatgggtcataaatcaggagccaagagaacacaaacacctgagaggaggtcaaggtcaatggttctactctggacagctcatcaggaaccattaaaaagccataggagtgagatggctatagagtcttacccaaaagatgattgaaagattactaatttaggtttgattggcctgaattctcaacagccaatatgtttatgcatgttgtacatctaatggaacaccattaagatggctgacactgtcgatttatgcatttattgacataattctggcagactttttctaacaaaatgtttatatattttttgtttgttcatttgtttgttttttgagatggaatctcactctgtcaccaggctggagtgcagtggtgcgatcttggctcactgcaacctctgcctcctgggttcaagcagttctcctgcctcagcctcctgagtagctgggacaacaggtacgtgccacaacgccccccaaaaatatttttgtatttttagtagaaacggggtttcaccatgttggccaggatggtctcgatctcttaacctcgtgatccgcctgcctcggcctcccaaagtgctgggattataggcatgagctactgcacccggcccaaaatgtttataacaatatagaaatacattatatttctaactcatgcaaaggtgccttatgagcaagcaacaatcctgccccaaggtctgcctggtctctggaaggccatggaggtaatggcaggagggcagctcttgaaatcagatgacctgcattctatacccagcaccattgagcagttttcctcaccattttaggtttgagtgtcctcatcagcaaaatgaaatctatttctagatgatgtttcagttacatgaatatattagattctttctcacctctcatttttcacatatgctattgcttctacttggaatgcttgtccttcactcatccccaggctggccctccacattcttcaagtctctgcataaatgtcaaatcttccagaatgctttctcttctaccttggttagatcccctactcaaggcttccatcagccatcctccacccaccatcaattcacatcaaatattatcataattatttatttcactgtttgtctttcccactagactttaaatacccatggacagaaaacatctctctctctcattcagggctgtgtctccactaccaagcacacagtagaaactcaataaaaatttgttacatgaagacatgaacaatgttaaaatttatatggaaaccattaagtctttttttaacttttaagttcggggtacatgtgcaggtttgttacacaggtaaacttgtgtcatgggggtttgttatacagattatttcatcaccgaggtattctcattttttaaaagaatttttctgtatctagtatgccacttggtttgtcaaagttagccaaattcacttgtctcctacttaagaaagttaattattgaagcctgatttcttatctctgcacatttttataaaactaaagtgctatataggcacaaatatattcttatgaagttgtgcatgttgtgaggacgtgaaaactaatttccactttagttgtactcagcaactcaaacggaatgaagtcgttttattaacaaacacccttcctcccaatttatttagtaaattcagattaattaggattatttcactttaaaagagtggactcttggtgttaaaagtgggggtggtggtgagggaagttctgttattatcgatatggaaatatcttgatcattttctcagggaaagaaatcaagataaagaacaccaaaagtgtgatttgcatgaccctatcccccagtctcccagaggactttgtctttggcagtcatgttttggaaggccaaaaatgatcctctgatactaaaagggagtagaaagacgagaccaactggatcttattgagaaaaggggcagcatttgagggaggtggcatatacccctacaggaggaagaatttactccctgggaggtaagattcttagcacctgcagatgtttaacagcacagactgtgaagctggactgcctgggttcaaatccgagctctaccctattatctggggaactttatatgttacttaatggtgtggtgtcaagctcactcatctgtaaaaatagggatagttatggcaactacattacagggttgtcatacaggtaaaatgaattaatgcattcaggagattagaaaaatgactaccataataagttcttaatactcatatatgtcaagttggacttttattatgtttagctctatattcgtgggcagggactgagagagaattgcttttgtaagatacagagtacactccagcctagcctgaggaaattggcaaaaactgaaatggcctgaggaaattggcaaaaactgaaaattcctttgggtaagggagcccaaaagagctgaggtcacttagaggccagactataatcgcttgagattctccaattctctgactttggtgtaggcagtggtagcaagggagaaggcagaaggcaggtgaagacaccagttaatgcagtaagggtggcagaactgggaaacaaaagcagccaagaagcagagatgggaaatgcctggagaagacgatcactagactctccagtcaaatgtttgctaggctttccttttcaggtggcttctgaagaacagcataacaaactgcctcatggtataggagacatctagagcccaaagcctgtataattgttcctcagttttttctcaacagggaaaatcccattagataattccaaagtgttccaagcacccagcctatttaatggtgccccctggagttgtgtaacacagagatgctgagctgagagatcataaattacgtttatccatctataagtgatttgttagcctattatttccaccttataattctgtaccatttcctttcactgcataacagaaactaatttacatctgcaactaatttttgcatttatttatgtatttatttagagacagagtctcactcggttgcccaggctggagtgcagtggcaccatcttggctcactgcaacctctgcctcctgggttcaagcaattctcctgccttggcctcccaagcagctgggactacaggtacataccaccacactcagttaatttttgtatttttagtgagacagggtttcaccatgttggccaggctggtcttgaaaacctgacctcaagtgatctacctgcctcggcctcccaagtgctgagattataggcgtgagccactgtgcccggccaatattttcatttagagactactgattcatcactaagttgtcaggagtggtatgtggtgtgtgtgtgtgtgtgtgtgtgtgtgtgtgtgtgtgtgtgtgtgtattagcctcttttaagaggttatttagaagaggaagacataattattcacttcatttatgagttgctctattacaatttggttgttcctttcgcaaagcattcgtgacattgttagaacttgtcattaagtcctttggcggagggctctacctctaatctttgcacagcactagcttcttactgtcctattttctcacccatctcacacactgcagctgaaaattgtggctgggcttgcatatgtaattagagttgtgcctctttgccaggttgtttcttcctcctctactaattggtctagttttccctttaaggcacgtaggaattatcagttaagtcaaatgaaaacaataggctgggtgatgtcagtttttgaaactgttgattactttccatattatatcatatggtcatgaggattactctgcacttatgggtaaactattcagctactcattagctcaatccagacacatcgaggcttgtcctggtttaactaacttttaagccatgtgacacaggaaaaacgaattcttcttcaagagttaaactgactatcatgctaagaccttcctttcctgatggcatttgtagtcatttttctcacaagccatcagttccaagacaaggatttggaagaaaaagcaacaaaaataatagtgcttggatatctcttaagaagctagggccatattttgcaaatatattattgtccattttcaagcatcctaacaagatgtgatagactcagaagcttcccagtagtagcataggctgttcctactaaatccagaggtttatggttatcctagcacaaggaatagcagcttcagatgttggccatggggcaattgttactcttactcccatctctgggagttctcgaaaactgtggtcccagaaccagcagcatcagtatcacctataaacttgttagataggcacatttttacggctcactccagacacaatgaatcagaaactctgtgggtggaagtcagcaatctgaatcttaacaaattgtctgggtgactctgatacatctctatcacatggagccccactgccaaccataaggcaaagtagatatgggccaagcaggtctgtacaggttttggtgaaatccttaaagctcatactgttaccatgagtcttagatcacagaaaacacagtgttagaatcattgttacttctatgcagaaaaggaagaaggaaaaaaatgcgccaatttcctggtaaatttccccaacggttttaacaatctttaccatatgcaaaatataatgttctcaaagattaaataccactcttgagacttaaagaaaagagaatagaagaccatacttgggaaaagaaatctctctcctgctatgggagaaatataacacttattattaggtaattcaaaaatctgttgcattggtttctaagacaaagaaaacttcttagacagagtcgccaagatgaatgagagtacctttccatagtgactttttcagtgttgacacacaacttctaacaagaaatgttcctaaagagtttaacctaattactaaagttctttttactcctgtcataaaggaaggggaggggagttcagaaaaaattgccttgaaatcagagtcccagactcttacacattccttacattcatggcattcatgagaccgtcaggagaccacccgtaaagacagacaaaagaagatggactggcggcagcacaaatagtaattatcaaagccattgccaagtggttatcccatggaaacacatttctgtatagtcagtaagtggcagtaatgataactgagggcatgccagccaatagaagaccatgaacagaacaagattcttcctgaccttatcagcaagagagggctttgagggaatggagatgcctgggcactgaggtcaccagcactcaagaggccaccccaccatgtcctcatcctgtgtgaatccaattgcttacttggattagctttgccactttacaatagatgcttagaggaaatcaaaataatttagcatgctaagtgaaattatacaaccaggactaaccaggtaatttaatgtagaggcacagccgctttgttcattagcattggccttggtcaaattatggaatctctcattgcttcagtgacctcatgagtccagtgggaatattattgccaacatactactagaagactcttgagagaaatggataaaaagggttgggttctgttgtattgtactgtacaattttgcatgtattttatttgtattttgatgaacaaattagaaatagcccatattccaaaccattctcactggaatcaagtgaggaaatcactaaaccagtaggcaagtatcatattttgcctaacattgaatgtttaaaaaagaccagtgaaatgcttctattaacagcagagttcttcattcagtgtgtgtgtgggggtgtgtgtgtgtgtgtgtgtgtgtgtgtgtgtgtgtagaaagagtactttaagccaactaaaaggcgagattgtcaacagagcctaggagtctgagaagtttgagataagcgatggtgatacaaacatcattagcactgagtcttttagaatacatattctatagctctccagcaaaccaagtcttcacatgaggaagtcactgaggcagcaggtagatgccatggtcctggtcatcaaggaggccctacattcacttctgcttgctaatggcatctctttgggcaagctctgaacctctccctaagcaacatctgtccttcaggcttagccagccagagtagctatgccacggcctaagggcagggcaattaagattcgttatgtcacatcaagagaagaattccaaatactgggccctccaccaacaatgcagcatcctcaccctcccacttcaagccctgaaatgttttcagtaaaaataactagctaatcataactgctaggaaggatagggataatctcagtgaggtcacaacgagctaaaaataagtcttttgagatcaaagagttacactaagaaggagacagaaaattcaggatataataactaatcttatatccttctgttctttctgaacctcaattggggcttggatgctgggatattgggatgaaggtgtttgtcccaaggccaagccgtatgctgaatcaattcctagttctacacaggaaagaagcatcattttagtctcagataaattaatagtacgcagctaaataactcaaaacagaaaagtcatcatagtgacagagttgtaaaagccagttgcaggaaattgcacaaaataagcagaataaatattactggagtgaattggatgttttatgcaacaaccacctgacactccaactttctttcaaatttcacttttcctcccctctcttttttgccagatgaatgtacttccagctggacttaagagaagcaacggtgtcaaacaacgactcattaagaaatacacacctgtcataaacgcaagaccctctcaggggagatattgaattgtgttccctgcttcctatgaaaaggtgcaatgaaaaaaaaaattaactatcaactaccagatgtttctagcatctctattagtttgagaaagatgaaacaattgctgcattgtacagatgtgtaactcacagaagtattttggatgtgggaggaaggctcaactaaatgtgtcttgagaataattgatcttttctttttggcactgcttcataataacaggaagaaatctcctcctctccttgaattgacacattttttaccaacactaagaataaatgaacatatatttaaaggtgcaagcatatggatatgcatttttcagtctgactttgcttcactgcatcaattataattatcttgaacttcctggtgacactcatacatgcacgtttcatgatttgaaagctttctagttgtagaaagctgtaagtactgtaaatcccattctccaaatagtaagaatggagtctggtgaggagaggttgtgtggtcaatggtatagagaaggacagagctaaaactattagagcctatgctctataactattaagagacaatatatacaaaatgtttgagttactcttgtcctcacaagcaatgctcgatgttctagtatatggagaagtcatcaatatgtgctattcaagaaaagggtcaggagtacacagtggcaacagcctcaacttctgcctatggttccacattattgcatctcccaagtgaatgggctttggcttcagccccttgtcatctcagtgccacaggagagctaaagaagggaaagcagagggggaatgccattttatgtcatggagtacagggctcacaaacaggctttagctcaacatgccaaatctgatggattttctctagtggctgtcctggctctaactggaaaaggattctgaggttgtatctgggcttaggcaggaagagaggtgaaatctattagcaacatttgccagtactttggaaggagatgctatcagctcatgaggaattttccagcttggggccctgtaacagttaaaagtgtggactttgaggccaaactgatctaggttcaaataccacagctatactacctacaatctctgtcacactgggaaatttacttaacctccctaagattcgattttctcctctctcaagtagggataactaatattatccaaaagagctgatataaagattaaataaaataatgtatggaaagtgtcttgctgatttcatgccatagagtaaaagctaccagaatgacaactgtggctatgatagtcatagtatccctagccacagtagtagcagtagcagaagtatcagcactaagttgatagtatcagcagcaacagtctcatagttatggtaacagtagtaacagtcgtaatattagtacaaaagtaatttaaggacaggcctgattttttttctggtatggattagacatgaaaattaatgagagagagagagagagagagagagagagagagagagagaaagtgcaccatgttctgattagctaagtaaactggaatcagaagccacctctggagcttatagtccacaggtaggtaatcatcattcagttgaggtgactccctcagccctagagaggtttgcttttctctcttggtgctctcagtagtgtggcatgtgccatatatattgtactgaaactgtgctgacactcctgaggcgaagggtatagcttgagctctccaagaaagagatgaggcaatgatgtgtggtcaggtattactgaaaatatttcaaaggcaaagaaaacagaaatggagggatggctactgtcccttgagccaattcattatcccactggtactggcccttatgatcctgctttttgagtggcaccgaacggtgagttatcatgtgtcttgaagagttgagagaatgtgtgatgagtaagaaaaacggagttcaggagcagttcaatgttgagaacacaggtggtgactatgttccctttggattctggagccactaagtgtaacagagtaggtttcagagaatcaaagatcatggatgttttacaaaggctctgtgcttcagttaaaagacagttcaatttgttagagaaataatggccagcttcacacaaatagtggaaaaagaacaaattcaggaggaggagtttaaaagaattttaaagagcactttcggtggaatactaaaggaatagcagctataggtcatagacttttattcctggaataaacctttgagatcatttaatccaacatcattatttacagattaataaacgcacatcttgtgaataacagcatgcggaaagagcttttaaaatcaggagttattgtactaaagagagagaaggagtccagaaatggacacgcagactgtggcgtcatctaagtacaagtagtaattgaactcatctatgatgatacagagggaagagatccatttcagcttccaagcaaaacatatagacagtgacacacccataatgaaatggccaaatggataccacccaaacatagataactatatggcccaaacaatgtgaataaattgaggaaattggatggctatatttcacattttttggcgtatcaagtgaactttaattactttttgctcctgggataaatttttctatctctcaaagattcttaaggaaagaaaggcagattcaaaatttgcagtgtttttgggaggccgaggtaggcagatcacttgaggccaggagttgaagaccagcctagccaacatggtgaatccactctactaaaaatacaaaaattagctaggcacacctgtagtcccagctactcggggtatgagaattgcttgaacccaggaggcagaggttgcagtgagctgagatcccgccactgcacttcagcttgggcaacagagcgagactcagtctcaaaaataaataaataataaataaataaatattttttaaaaattgtacaatgtgataccatttggccaaaacatataaatacataaagaaaaaagagtataagaaaggttaaataggtctagtggtgaaccaaatacttatgattacattaaagaatgcaaaaataatcattcttgaaagcaaagctaaatgagttaaaatagtatttaatattaaacaatatggatctacagtgacaaataattccaacaaaattcataagatgggtctacaagagggaggaatgaaaaagaagctaatgacctcaatttagatgggattcaaataattgcatttattttgtgacactgataattagagatatacaggttgcacatattctataatttaacagtgaaatcataataaaaaatacattcagtgtttctagagacaaagcagcccaaaaaataactagtagtagttatgagcactgactactaatgtatcaggtacttttaaaacatttattcctacaaccctctcgataaccctaccaaatgggtactatttttatccctatttttcaagttttaaaaatgaggatatttaggcacaaagaatttaagagcttctgattcttgaaatattgaaatgggacccatgcccgactaggcatatgcttgagcttatggtcttaaccaatattctacacatggatcaaaagatgaacaccagtaagaatactaggaagctgtttaaaaaaaataaatgaagacatcagaagataaaatatattagtatgaaaattaacaaatttgttaaactaatttaaaaatattttagcaatagaattatatattatttagaagagataatatatagaacaaaatgttcagaagtattaaaaataaaaggatggcaaatatgtatcaggaaattgaaagaaaaaatagaaagcattaaatgcagattgcaataaataaaaaataaagcaacactacactaatcaaaggtataatccacaataaaatataatagtcaagcaatgctgtccaatagaactttctatgacaatggaaatgttctatacttgttcagtccaaaatggtagctactaggcacatggggtttttgagcactggaaattcaactagagtatcatataaactgaatttaaaattttatttaattctaattaatttaaatgtaaaaagtcacatgtggtgagtgcctaccataatggacagtgtatgtctaggtctctgtagaaatatatatgaagtaatgttgctacaattaaacagagtttaagagaagcatatttcagtgttttattataaaacaattctgaaatattcaatagaccaaaacaaaatacaatatagaaaaactgaataatttaattgctaaaattacttaatagttacatatagaactttgcctcaaggaatgtgtattcacattcaaggatgtttacaaattgtcacccacaaatagcctatttttagatttccccaaagtagacattttaccagctacaatgtaatgacttagaaatttataacaaaattttaggcaaatatacaccaacaaaaaaaaaaacaaattggaaattttagaagcattaatctaaatttgtgcacgtatataatgtaaataagctctacaattaaagacaattacaacatatcaagataaacaggttgtggtaaaattgtacacaaaggtaacttcataacattttattgaaattaatcaataaaatagtggaaataaatgagctaagtcacttactaagagaacaagattataagaaaagtcaagaaaggaaataataaagataaaaggcaaaattaatgaattggaaaatagaacaaagtaataatttcaaaaccaaatacctgagaaattgaaagattaaaaaaaaatacaggaaaaccctcagtatagttttaggaaacaaaactgagaaatatcaaacaccaaaatgtagaaatgagaaagggaatataaaaaacagtcatggaggctgggtgcggtggctcacgcctgtaattccagcagtttgggaggccaaggaaggcggattacctgaggtccggagttcgagaccagcctggccaacatggtgaaactccatctctactaaaaatacaaaaattagtcaggcatggtggtgggtgcctgtaatcccagctactcgggaggctgaggcaaaagaatcacctgagcccaggaggtggaggttacagtgagcagagatcacgccactgcactacagcctgggcgacagagtgagtccctgtctcaaaaaaaaaaaaagaaaaaagaaagaaaaaagaaaaaaagcagtcacagagatgcttttaaaaatattattataatcatatgctaaaacattttgaaatctgactaaatggattatttctagcaaagtaaaagttaccaacattgacttgagaagaaataagaaaacttctggctataacagtaacttctaaaactatgattattacaaattatctccaaaaaatccaccatgtccatagagctttacagatgagttctatcaagttttcaagagacagaatactgttgctctagaaacatttcagaccatgagaaatgtagaaacgtaagactgattaaaaatctgacaaggaaagattatagaaaaaatgatagactaagctattcttaaattcataggcaaaaatcaacattgaattgaagcaaatcaagactattaagacagctgctgaggccaggcctggtggctcactcctattaatcccagcactttggaaggccaaggcagggggattgcttgagcccaggagttcaagaccagcctgggcaacacagtgagacctcctcactactaaaatgttaaaaaagtagccaggcatggtggcacacacctgtagttctagctactcagcaggttgacgtgggaggacgacttgactctaggaggtggaggctgcattgagccatgttcgtgccattgcactccagcctgggcaatagagtgagaccctgtctcaaaaacaaaaaaacaaacaaacaaaaaaaaaccaccaaacgatctgctgtatattgaaaaatgacacaccttggaaacataaaatttacctaggatttagtactagaaattttactactttgattaagcacttgaatatgtcaaaggagaaaaatattatttcaagtagatactaaacaaacatttgtgtacaaaagatttgaaaagacacttcaaaagtaaaatatacagagagcaaaaaaaaaacccataaaaaggtgcttgacatcactagtcattaaggaaatgctaatcaaaattacaatgggacacaattacacacctattaaaataactaaattttaaaaattaaccataccaggtgttggtggtgagaatgcagagaaactggaactctcacagactgctggtgggagtataaaatggcacaaccactttggaaaacaatttggcaggtcctttaaaagttaattatacatctcccatacactccagccattccaagagaaaagaaagtatatatccataagaaagacttacacataaattaccaacccagttttcaatagtccaaaactggaatcagcccaaacgtccattagtggttggatagataaacaaattgtggcatacccatacaatggaacactattcagcaataaaaaggaattaattacttatataagcaaccatataggtgaacccaaaataattatcctgaaagaagccagactaaaagagagtacacactgtataattcaatttatatgaaattctagaaattacaaactagtctataatgacagaaagcatgtcagtggttgcttggggataggagacagagaggggctagagggaggggttgaaaaacacaaggtaacttttggaggtgatgagtatattcatcatgttgattttaatgataatttcacaggtgtatacatatgtcaaaagttacctaattatacagtttaactgtgtgtacttcattgtgtgtcaattgtaccttttaacaaaaggatggaagtgaaagaataaaaaaagatttaacagaaacattctgaaagaacactagtacacactagctagaatagacttgacagcaaaagagatttcaaggtaaagaggctcttcataaagtggtaaatgaaaaattcaccaggaatatgtaaagatcccaaatgtgtgtgcattcaacagagtagcatcaaaatatataaagcaaaaaatggaaagtactactaggagaaattgtggaaatgatactcatagtaatacaaaggaagatgactctctcagaaatcaagtatatagcaaggaaatagaagactttgacaacacaattaacaaaccttaattaattgaaacagaaaatttctgcacccacctaagacaattgagcttattttcaaatattcatggaacatttacaataatgaccatgtaatagttcacgaagaatatctcaacaccaaagaactaatatcatacagcccatgttttctaatcacaattcagtaacatacagctaaaaaatcgtatttaaataataataaaaatacagtagggatctaaaaatcacacatcgagtttccaatcacacatatcagcctagatacacacatgttcacctctataccttccccaaacactattaaaattacagggatataaaaaggccaaaactcacaaagataaagaactagggggaaaaaagccacagccactgtattttggaagcagaaatagagatgaaatttacaatggtaataagaaaaaccccaaagcaggacgattcataccatagaactccggaatcactcaggaattagaaccactggttacctttaaaattgggttacaggtaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcataattaaaagaattagaaaagcaagagcaaacacattcaaaagctagcagaaggcaagaaataactaagatcagagcagaactgaaggaaatagagacacaaaaaacccttcaaaaaattaatgaatccaggagctggttttttgaaatgatcaacaaaattgatagactgctagcaagactaataaagaaaaaaagagagaagaatcaaatagacgcaataaaaaatgataaaggggatatcaccactgatcccacagaaatacaaactaccatcagagaatactataaacacctctacgcaaataaactagaaaatctagaagaaatcgataaattcctcgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattctaatcaatacaaaaagagggaatcctccctaactcattttatgaggccagcagcatcctgataccaaagccgggcagagacacaaccaaaaaagagaattttagaccaatatccttgatgaacattgatgcaaaaatcctcaataaaatactggcaaaccgaatccagcagcacatcaaaaagcttatctaccatgatcaagtgggcttcatccctgggatgcaaggctggttcaatatacgcaaatcaataaatgtaatccagcatataaacagaatcaaagacaaaaaccatatgattatctcaatagatgcagaaaaggcctttgacaaaattcaacaacgcttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattacgcaggagaaggaaataaagggtattcaattaggaaaagaggaagtcaaattgtccctgtttgcagatgacatgattgtatatctagaaaaccccattgtctcagcccaaaatccccttaagctgataagcaacttcagcaaagtctcaggatacaaaatcaacgtgcaaaaatcacaaatattcttatacaccaataacagacaaacagagaggcaaatcatcagtgaactcccattcacaattgcttcaaagaaaataaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacagctatctgatctttgacaaacctgagaaaaacaagcaatggggaaaggattccctatttaataaatggtgctgggaaaactggctagccatatgtagaaagctgaaactgcatcccttccttacaccttatactaaaattaattcaagatggattaaagacttaaatgtgagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggtaatcattataaagtcaggaaacaacaggtgctggagagaatgtggagaaataggaacacttttacactgttggtgggactgtaaactagttcaaccattgtggaagacagtgtggtgattcctcagggatctagaactagaaataccatttgacccagccatcccattactgggtatatacccaaaggattataaatcatgctgttataaagacacatgcacacgtatgtttattgcggcactattcacaatagcaaagacttggaaccaacccaaatgtccaacaatgatagactggatcaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacaatgagaacacatggacacaggaaggggaacatcacactctggggactgctgtggggtggggggaggggggagggatagcattaggagatatacctaatgctaaatgaggagttaatgggtgcagcacaccagcatggcacatgtatacatatgtaactaacctgcacattgtgcacctgtgccctaaaacttaaagtataataataataaaataaaataaaaattaaaataaaaaaataaaataaattaaattgggttacaggtaaaattgaaaatagcacacaaattagctgcattttaaaaagcagttagggacatgtatctcttccctaactcaaacaatctggaaactactcccatttcagtaaaagtctgcagacctattctctggcagtgatgaatcaaaggaaccctggacttgcggctggtcagagaaaaggatgctgcactgtagacagaacaataaagtaaaaatctactgcctgatgagtgagatcccactgagaagccagcattaaatatcccaggagggagatggaaaacttctccctgggaaactgagctcaaagaagaggctcaaagctactgagatttgtaccccccacctgacccagataactcatcccagtgatcctacattaaagtccacactctataaggccctcctcccccaacatccacacaggaatccagagctatcaattagctcttttttacatggtggaagcaaaggatcctcagaccttcgagaaagcctctaatgtgagtgataggtgaataccaaagaggaattgaagaaaatagaagtaaatcagtgagaagatacttcaaaaaactataatatcatccaagagataaaaaagatatggcattcaggaaagtagaacagggttttatttttaaaaagaaagaaataaaaatcagatcatagaaattaaaatcatgataacagtaattaaaatgtaggagaaggattagaaatttagaagaaggattagaagttgacaatcttgaccagaaattaaaacaaacaattgggaaaactagagaggaagagaaaaacattagaaaataagtttaagaggtctaaaatccaaattattagaaatttcagaaagagagcagagaatagtgtagggagaaaagtatataagaaataatacaaaaataaatttcctaaaatttaagaaatttccagattaaaaattcctgtcaagtacccaacacaacagagtccttcagtgaggttaagtactactctgttttattatatggctacaacatggtgtaccattaatagttaactatataccagcaagaaatacagatagagatattcctgtcaaggaccatcaagatacatgaggaaagcatcccagagcatctttgtatcattataggatcaacttccctatgtcaccatgaggaaatactcatagaaatgttctgccatataataaaaaaaggacaaataccatatgatttcactcatatgaggtacttatggtattcaaaatcatagagatagaaagtggaatggtggctgccaaaaccttgctgggaggaaagaaggacaagttgtgtttaatgggtacagagtttcagttttgccagatgagaaaagttctggaaatggatggggatggtggttgcacaacgatgcgaatgtatttaatgcgactacactgtacacttaaaaggattaaaatagtaaattttgttacacatattttaccacaattaaaaagcattaaataaggtatttgggagttattgggaagcaaaacattcaaaattttttcttttgtaaaataaggaaagaatgaaagaacacttctatttaacattctcaactgcatatatattgatgtgcacacacataaaaacataatgtgtgtatagcatttttcactcaatatttaactttgttatttcatactgactccaaattcataggtgtttatgcagataatcacatgactacatatagtaactcagactgtaattttactaaaaatggctttatgttcatgggtggttatacttaacctagcatcttttgtcttataattacatagcttaaaataaatgactaatgtgcagacattaaaaatgaaaaacagaaatatagctgggtggtcagacaagctttgcattatttaaagagaatgttccggaatggtaaatttataatagcatatgttcagaatacaaaacaatgaaaaatatcccccctttatagttttctgcttacaaacatctcttcttatctctctcttctcctattatcctcttatcgggttagaaacaaactttgaaaagttatcttctactctatcacagctttgaatgaggatcagtattacaccatactatttatagcctctaagcagggagattttctgagctcgctgataacttaggtctgcttgaactatcttctcttaagtaatcaaagctctttatttctttcccactttgcatttagtggaaaaagaaacagttgaagtctatgttttaggttcaaattattttttaatgtactcattgaagaaacattttaaagtagattatcgctaaaaacaatagtcttgtataccatatgaaaccatgtatgtgccattctagataaggaaaaactttcgttgacagagaaaagatcagtagcagttgtctggggtcaggggtgagaagaggagattcactgtgaaaggccataagggaacttcttaaaaaaaaaaaaattcagtagttttagtagtacaagcgctttttggttacatggataaattgcacaatggtgaagtctgggctttactgtatacccatcacctgaagagtgtacattgtacccaataggtaatttttcatccctcacatggaacttcttgattgaggtgctggtaaccaattgtacacaataccacaatgtatcacattgtacactaaaaatgggtgaattttattgtgtgtaaataatatcttaattttaagaattgctttgttaaaaaaataccaaccctgtagtctcactactaaaacactatcagtattaatacattggtgtgttttccaacaccatttctcacagacacttatttcttcatttgtaaacataatttggatgatatagttttttgtagcttgtttttattgtaagcacttgttacattacatggtcttggaaaacaatcattttcaatggctacctaatattcaatcaagtaataggaattactgaatggtcaaaactatttaaccacttgtctattgatagccacattggttgtcaccaattatttagttacataactattactgagaaaaaaattttgtgcacgaagttctttttttctataggcttcaaaattcagaagtatttttaggatatatttccagaagtacaatattgagccaaagggtataaacatttttttttttttttttgagacagagtcttgctccgtcaccaggatggagtgtagtggtgcgatcttggctcactgcaacctccgcttcccaggttcaagcaattctcctgcctcagcctcccgagtagctgggattacaggcgtgtgccaccatgcccagctaatttttctatttttagtagagatggggtttcaccatgttgatcagattggtctggatctcgtgatctcatgatccacccgcctcggcctccaaaagtgctgggattacaggcatgagccacagtgcctggccaggtataaacagttttaaggctcttgccaaactctagattcttgccaaaaaagccatactaatttacactgcttccagcaacgcttaatgaccttgtcacctccccagagttggatatattatttttttaatcttaaagacttcctaatgacctctccccacaacctttcagccataattacctcctccatttttgtgtgtgtgtgtgtcaagcttttaacaacttttccttttttggtccctttcattcctcattttctcttccttcttccctcctctcatccaccaggtccccttacctctcccactggtttctactataattgatgtttttcttccttattgagtggaaaacctccactgtaatataaattgggaaggaagctgttgctttgaccaaaacagaacttaaggcatgagaaaaaccaaaacaaaacagctcttccctggaacatagcatggccagagaaaccaaaagcatttcaaaaccaaactggagtgtcagagaccagatattgaagactgtcttagggagagggagtctgggagggcagagcactcaaggagacagatgtgaaagctgtcaaacttcctgactacattcctacatcaggggataatgcttgaaggacagcaaaccttagtctgatggttatatcttcccagatgtagagacacaggttctgactgtgtcagggtccatggcccctggacctttatattgaggcacctgacctgctctcagggttgcatgaccccttgaataacagagggaagtgttaagggcaacatgattttgtgtcatgggaagtcagggaccccgaacagagggaccagctgaagccacagcagaagaacataaattgggaagatttcatggacatttattagttccccaaattaatacttttataatttcttacacctgtctttactgcaatctctgaacataaattgtgaagatttcatggacatttatcacttccccaatcaatattcttgtgatttcctatgcctgtctttactttaatctcttaatcctgtcatcttcataaactgaggaggtatgttgcctcaggaccctgtgatgattgtgttaactgcacaaattgtttaaacaatatgaaatctgggcaccttaagaacaggataacagcgattttcaggaacaagggagataatcttaaagtctggctgcctgtgggctgggcaggacagagccatatttctcttattaccgaaaacaggtaagagaaatatcactgaattctttccccagtaaggaatattaataattaacagccctgggaaaagaatgcattcccagagggggcctctaaaatggccgtcctgggagtgtctgccttatgcagctgtagatagggatgaaacacgccctagtctcgtgcagcgcccccaggcttgctaggattaggaaattccagcctggcgaattctagtcagaccagttctctgctcttgaaccctgacaatgcgtgcacagcgggacatggaagttcattagtgattctagtttcgccctgaccttctgccttgtgatcttttgttgcccttgaagcatgtgatctctgtgacccacaccctattcatgcactccctcccttttgaaaattgctaacaaaaacttgctggttttatggctcagggggcatcacggaacctgccggcatgtgatatctccctcagacacccagctttaaaatttctctcttttgtactctttccctttatttctcagaccggccgacacttagggaaaatagaaaaggatccacgttgaattatcaggggcgggttcccctgataagtttgtgaaggattcaaggattccagcatggtgtagtgaaaggagcatggacctttgaggcagacagaccaggtctgactttgtagttcaccacttactagttcttacacatgttacttactttctctgaacctctgtttcctcatctgtgaaatatattatcatttcctttcttaaatatttcccttcttaaatatttcctttaaacagcaaaaacctggggacataagagtaatctggccctagtggaacaagcacacaataatcagctaaaagaataaataaattcataaatttccttccccagtttggactctagggttagttatttcactggctctcctgaaaaccttcaatttgcctattatgcccaattctgtcaacctccaacccatagtagtcatttgctttcaccattcctaagtttgtactgaaggctgctaaaaaaattacatgaatgttgttggttaccattataaacgtatttgtgatccagggtatttctgtttgcaattcattggatatgtcaccatgaaaaatgccaggtaaatataagatgaaaaggcatgggatttgatattgatggtgaattcttatatcagcaattagagtgcagggctctttcccctttggatctagaagtgggcaggagaagagtatagagatgattccaggcaggatgggacaaaatggtaatagcacattaaaggaactgagaataattcttactcctggagaaatctttcacaaggtggagaactgttgtgtgtctgtagaagaatctggggaatccaatattcaaaaatcacagatgaggaactgaagaactcaagagctaaatatctagaagtagggactaagccaactctagttttttaagctgttgccaatgctgaaagtcattgaaggattgtgaataaaatttcctagttagaaatcataattgttaacttctgaaaagaaaggtttctgtacatgtgccaaatgtttccattcatgtgaacatataaatttgaatgttgttctgtggatcacctgttgaaagctcaaactaaggtgtctggactgtcagtattatgctcgtttggttgccttaccagaaatccttgagtgtaataattacctaaggaaatttttcatgctgtctgcagtgatttatcacaaggaattgtttggtggttttaccacttagaaatctataaaggaaatgaagactgttcactttctgcagaaaacctaacccatgtacttaatgcttactctattgtatttattttatgtacattatacactcttctaaaaccttgaacataggggtttcaagatgaattagtggcagtacccactgaacacagttaacgttccgatgtatgctatgtggaatattccagtgaaagaaaaatatttttaaaggtaatagcaggaccttcatgttaagatgaagtaaaagaagacattaatttccaacagtagaagactcaagtctgcttgagtgtcgcttctagttttccttctacatctttgatgatcctttcccagttttccgtcttttatactgatttctttccatccccttaaaattacacctccccagcccctatccagatctctgctccttttttccctacatactctcccttgtttattatatctatgcccatgactccaactaccacttaattactaatgattttgaattttatctacaacattgactgctctataaaattccagatgtgtattcccaactatttccttcaagtacttaaaatttgatgtctaaaattaacttatcctctcacattcacttcaggacttgctttttccactataattcccatctcaataactttcattactattcacctaataatgtaaattggaaaacttgagttatccctatttttcttcctcatgacccattactttttttgtttgtttttggagacagagtcttgctctatcgcccaggctggagtgcagtggcatgatctcgactctttgcaacctctgcctcccaggttcaagtaattctcatgcctcagcctcctgagtagctgggattacaggcatctgccaccacacccagctaatttttgtatttttagtagagatggggttttgcaatgttgccgagggtggtcttgaactcctgagctcaggcaatccacctgctttggcctcccaaaatgttaggattacaggtgtgagccactgcgccagccccattaatttccatgtcataaagtcctactgattgtcctctctagagatctcacagatacacctgccaacccccccatcactcccccaccacatcttcactgtgaccatctcattagggcctcattatttttcacatggactatggtatcagctttcaaactggtcttcccactatgagcaattcttcattcatgcctcctcccaataccaccagggttcttgcttgaaaatagagacatcaaaatgtctgtcagtctttcaattaaaactttcccaaaggttccccattgcttatggagtaaagtctagataatttagaactatatcctagtttgtccccaaatctgatattaacttttcttaatctcatctccttatattactccctacctaactaccaatggtcacgtcaaaaccatccctatcacactctaacttagcctacttccttaatttcttcttttctttgcacaccctcttctttctgccttggccaaaccataaatacctacatatttctatcagtcgaggtcctcaagtccaaactatactcattctagcaaaaggacatttattataggatactggtagttcacaaaacatattgagcggtatgaagaagcttacaaagttcccagaagagtcagggacttttgtgtactcagatgccaagaacaatacccaaataccctagcctcctctttctgactcaacatcacagatttccccacccctgcattgctcacactaaagctctacttctgtctccaaaaggcaaacccacacacctaccacttccattgctcacctatatatcaatgtctcctgtttacccctctgactgctggaatctaggtaataggcaagtgtttagctccaagtgagtctggtgaagaaaggtttttgccttctatattggggatgcaagaagtttcccaaccattacaagagtgtttaaacggtctaggcagctagagaatctggcaactacccacaacatccttcctctttgatggccagatttatatttcccttccaaaactaatcaccagattccttcaggcaattggctctcaatctcatgaggcatacccctgccatggccctcagcatgctgtactggaattatgcatttgcatttccctcacttataaattccaaaaaaatccttgagcatcatgggtatgcctgatctttctttacattattctcttctccttatttaacatatagccaatgtctggcagatggcaagcacttaataaattttctttttggaaaaagtgagtaaaaattggagtcataattcaaatgttctttatctgcaaatattttagtgatatacctttagctgaattcttttacttaatattcccaattcaagggaagattttcaactctgctgcaataatatagcattttaatacacaaagtgtttaaccaatactaaaacccttttaaatagtatgtggttttctaatatgccctagcaaagctggaactctagcatgagtgttcccaaagcttaacaaaacacaagcaatttgaattcaggattccatgatgtcattaacaaagatgtgactttgaaacggaaacagaatagtggggaagatttctgagaggagacttcaactgtaaaagtcattttaaatgaattctatttgtttcgttaataatcatgggatttgcattgatgttacattgcctttactttaaagcagtctccatggatctgctgacagcttcatgagctgattgtgacaacagtctatgtccaatgaaaagaaatgggcaagtagggagtacgtatttttataagtgaacataaagagaacaatgaatatgcaagttccctttctacctttgaaatatatatgcttagctttttgaaagaaaatttggtcattcagagccaattcaaggtatttaacgtccatctttgatagccatttagtctaaattgtgaatccattagttctgtgagaaaaacaattcacatagagcctgaatggtccctccctgcccctgttccctaagttgtggccctaattccatggctctacagtcttgtagagtagacaatgtatgtgagggatgaggggtggtgtaggggagacataacacaacaaataccaaatatattagaaaacacttgcttgaaaaatgtgcatctcagatccaccttgatcattgagaataaaggaaaaaacaaagtcaatttttatattcaaacccactcttctccccacatttttaaagatgaaaacaaaagaaaatgagaaactcaacactgagccaagatcattcattctctctcaagtaacaaaacttctttaatatgaaaggaaaaccatactaacttccctatcctaaaggcacttactgtattcatgagcttttcattaaagagaagaaagaatctagttcaaattcctacaatatttatcatcacaggcactatacagggctagtttaaacgtactgagagcatttcagttacaatatagataatccgctttccaattataacagctcagtttaatttcatggtagacttggcgagtgaggaaggatagacaggcattcatccatagtcttgatacagttcttggcttaatttcaccaatatacagggtgagctatgaggaaccattaattaatgtccaaaagaccatgtggaagatggatgtttattcaatgaaatgactattttctcagcctgtttccacactgtgtgaataaggattttccatcaaatgaagaaaagagaacttttcagaaatgtctgtgcttctaaacattaggctgaaattcagacagttctcctaataaattctgacagtgtttatacatgtttttaatctaatcatttatgtattcttttttcttctaaaataattaatctgttaatgcttgtagctttggcaaatagcagaattgtgtttttacagctatggttgccccagcctatacatagttgtcacttctgttttcctacaatacttcagcactagatttctcttcctcaccctttcatctgcatccttccttgctctatttttcttcctttttctctttccctctcttctgttcttctacctttctccattagctattatcataatatagaactgagatgtttttatttatgaaatatcttgcaccttaaataaagtggaaaccatgataatactaactacgttgggttcttgtgaggattaaataatatacataaaatgcttagaacaatgccaaggagagatgaaaagctatgtaaggataagttagcaagaattatcttgatttttggtagttattgaataacattttataatccttgttattaatttagaagagaatgtgtaaacaatggtttttcatctattgaggacagcaacaaaagctctaccctacaccccagaaaactgcctatatacacaacattttgcacattacatcagagctctcatcgatatctttcatccctctattgactccttagttgcccataaaccttacttaagaaactctgctcgatagagaaaaagttttcctaccctgactagtaccagattacacaaatgaaaaacaagctatgtgcttagaacactaccaagcgggtgggagagagggtagaggagggagagagagggctctttgaaaaaaattggttattgatacttctataaataaataaaatatttaccatggggaaaaaagtaagacaatgtggcatgtttttgtacttcttttagggtttggcattattttattttgcattacattggaggagttcatttttttaggtgtcagagccatgatccatccataccctgcctgaagactgaaaatggtgtggtcaagtggaaacagcagagattctgcaagcaagagaactggagtttgtgtttggattctctttttccacttccttgctttggacaaggcactacatctctcagaacccttgcttccttggctctctgagggtaagatcacctacctcttatgcttattggggagaatacaagatcggtgtggtaaggtgcttaatagttacaggttcccttgactttgtttttttaacagtaaaattgtgctgaataaatagatcatggtgaagcgtgttgctcacattattttaatggcaattttagagactgtcactccatgatttctgtgcattattgatcatgagtgacaggttttgtatttttttaactgcaaaatttgaaattagaaatattatcatagcatactgttgctactctgagaattgagacatccttaaacaacagaaggaaattgtccatgtgactattttcttttattttataggggaagatatggagaaaaaaaaaggctgagaataggacaagaatgaaaaggcaaaactgcaatttcacataaattccttctgcttatgccatttgcagtaattaatgtactgtaaataggacaattttttgtattttataaataaattttcactgtgaggaaaaagtgccatttcctttacttcccatccacatattgtgccgaaagtgcactttttattattattattctgtacttttaaatatttctacacaatttatcaaatatccacccagaaaccctaaatattgaggtggatatctctgaaaacaattgtcagaattcctttccttttgaacacccatcccaccaggcatgaggattaaaggcagatatttgggtatcatgtgattctcctttgggagataatgacacacatgcagaggctgaacaatgtaaataggctaacatcttggaaaatcatcccaaaaaatttgtgtataaggatttaaagatttcttctctttcttttttcctttctaaccttgatgattactgtacttatcttttcttatttccccactctccctttgacaaaaccaaagatgatacttggttttctaatttccctatctgaagcattctatatgagatatacaagtttcgttctccttttcttcttgtggtgggaagaaagctcacacttttcatttgagacactgaatctaatgaacaataacatttatatgaaatgccacctattccatcaataagcattattgaagatctattatatgcaccaacattaggcactaggggcacaaatatatgttagatataattagtgtcctttacacatgaactgtctaagacgagagacaaatgtttaagtaagttttataacaggaatacactctttaatacaggcatgcactcaggagtttgctgacacagagaatgacatgatgaattctgcttaaaagaaaggggtatgagagatacgatctcaggaagctaagatgtggaaaagaatcttaaaaggtgagggaagactagatcattggaaacacccctccaatgagggacaaactggacaagctgtttaaaacaacttgttgagaaaagctggaaaagttgtttaaaacagctgctttaaggcattgaactgctaacaagggattaaacaactttaacttcaaggaactgggagcagacagaactgcagagaggtaagcctgccatttgggtattccttctcctttaagacatttgtcaagcccaaatgagggaacgaagaagctgagaagttgagcaaaatgtctgacagtttcctaagtctaggagaacaaaattgggagtccaggatcaccaaagaaagtgagagcctactcaccatgcaaggctgtggagtgggaccttgaggagttgcagaggaagagtcaaggtaagttggaaaaacattattcctcccagggactccaatccaagtgccaggcacatggtgatatgcaataaatgattgttgaacaattgattaaatgatcacatctgtgaatcaagggagtgatggcccctcttctgccagctgccccatcagagagcacacaatagctggatggccaagtggcagaaggcaagttggcaccaagtgccaaaagaatgtgaatccacagagtcagggttctgaggtaggaggaattaggcaacaagagaaagagggtggaagggacatacagctaagaccgggatatacagctaagaccatcatctctagccaactctgttccacttggaaaacaggagagagagtggggagagagagagagaaaagagtgtgtgtggaaagagagagagagatggggagagggagggagagatggggagaggacaggaagagtggggggatggtggtagaccacaacttagttaagaaacagggcaaacttcattatattacatatcaatcatagttttctacacttgtacagaaaatttactcctgaaatccactacaatattaactattaatatcaatttcaatttgcaccacactggaactagtttcattttaactatggtctgtggggatctcgatctctcttgatttctaatcctactctagatccccattatttaagggcttgaatctccaaattaaactgttttcttacctgattgaaattgttttccttccttgttaaaacttatccacattctaaaaacttaaggtttcatgttaaccactcagaagtgagagttgttcaaatctgtgcatgattttctgaaaaattagagttgtgagtgaacaaaggccaagttttcattttgtagctgaatgataaatgaggtgaaactaggatagcttttataaaaaatgcaaaataaagatttgtctttctcttcctctcatgcttagaagaataagctgagtgccctaaaaagcatatttattcaaacagcaaatctggtcttattgaactgttctctgtgggtgccacatgtttacaaatatccttatcctaaatttctttcttttctctcaagctaatatcctgtatggtgtgcattaatgcaaaattgtttaaagggtgaaaaatcaaaagtcaggaaatgcccagttaaggatcttaagaacagtgagaacttggccacactgcataccctgggcaaattatgacacagtttttaccacatgaacagaactgtattgaaggtataaatttaacaaggaaaagaggaatagaaaaattacattcaggccacaacacccacgtaattagggtgtagaagttttggaatttcctgacaacttttctaaagtttggtctttgcacagaaatattgtggtaacatagttttttcatttaatttccacgagtttacaagagaagaaagcattctagagaaatcctcaatttagcagttcctaagctcaatgttcttaattcatgtatctttatagaactgcaatggaacaaaaccaatcaaagcaaaagattaatatgtctttataggctttcattctttacattgtattgagattttttcctgagctatgatgaacatactgctaaagtgaagttttaagtttgtcatttggaaatgtgaaagcataggcatttgtgctttaaaaaaatttttttgagcaaaaaataaatggttaaaggcgagtgaagaagaatctgaactgaggaaccctcattcattctcattttctttcccagccaaagtcttaatggttgaagaattaagtttacacaaggataactctttagtacgctttctcgctctatatgtgcaaataataatcacatgtagtaatgtggtttcctagataaggtcagatgaattcatttgtatcttctgagaattaaaagtcagtggctatttaaacacaattttcctaccaactttccaaagaacttgtagatttccaacaaaattatttgtgaaattctgagtgtgaaaaataatgtatttttaattttatgtaggtgtatggatgcaactactccatcattaaaacattttctgaattgcagattcaaatgtataaaaaagattatgcagattactacgtttaatctagtttcataaaaagggtagaaattaattaattaggcatttatttcttaagcagggtgagaaaattccatatacagaattgtaaaacttattacaattattattatttttattacatttttaacttaaagtttgtattttctttttaattatactttaagttctagggtacacgtgcacaacatacaggtttgttacatatgtatacatgtgccatgttggtgtgctgcaaccattaactcatcatttacattaggtatatctcctaatgctttccctccccactctccccaccccacaacaggcccctgtatgtgttgttccccttcctgtgtccaagtgttctcattgtttaattcccacctatgagtgagaacatgcagtgtttggttttttgtccttgtgatagtttgctcagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttataacagcatgatttataatcctttgggtatatacccagtaatgggatggatggatcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcaccattctaactggtgtgagatggtgtctcattgtggttttgacttgcattactctgatggccggtgatgatgagtattttttcatgtgtctgttggctgcataaatgtcttcctttgagaaatgtctgttcatatccatcgcccactttctgatggggctgtttgtttttttcttgtaaatttgtttgagttctttgtagattctggatattagccctttgtcagatgagtagatcgcaaaaattttctcccattctgtaggttgcctgttcactctgatggtagtttcttttgctgtgcagaagttctttagtttaattagatgccatttgtcaattttggcttttgttgccattgcttttggtgttttagacatgaagtccttgcccatgcctatgtcctgaatggtattgcctaggttttcttctagggtttttatggttttaggtctaacatttaaatctttaatccatcttgaattaattttagtataaggtgtaaggaagggatgcagcttcagctttctacatatggctagccagttttcccagcaccatttattaaatagggaatcctttccccatttcatgtttttgtcaggtttgtcaaagatcagatggttgtagatgtgtggtattatttctgagggctctgttctgttctattggtctatagctctgttttggtaccagtaccatgctgttttggttactgtagccttgtagtatagcttgaagtcaggtagcgtgatgcctccagctttgttcttttggcttaggattgtcttgggaatgtgagctcttttttggttccatatgaactttaaagtaattttttccaattctgtgaagaaagtcattggtagcttgcatccaaggatggcactgaatctataaattaccttgggcagtatggtcattttcacaatgttgattcttcctatccatgagcatggaatgttcttccatttgtttgtgtcctcttttatttcattgagcagtggtttgtagttctccttgaagaggtccttcacatcccttgcaagttggattcctaggtattttattctctttgaagcaattgtgaataggagttcactcatgatttggatctgtttgtctgttattggtgtaaaaaatgcttgtgattttcgcacattgattttgtatcctgagactttgctgaagtcattaaggagactttgggctgagacgatggggttttctaaatatagaatcatgtcatctgcaaacagggacaatttgacttcctcttttcctaactgaataccctttatttctttctcctgcctgattgccttggccagaacttccaacactatgttgaataggagtggtgagagagggaatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagtgttgttgaattttgtcaaaggccttttctgcatctattgagataatcatgtggttttttctttggttctgtttatatgctggattacgtttattgatttgcgcatgttgaaccagccttgcatctcagggatgaagcccacttgatcatggtggataagctttttgatgtgctgctggattcggtttgccagtattttattgaggatttttgcatcgatgtttatcagggatattggtctaaaattctctttttttgttgtgtctctgccaggctttggtatcaggatgatgctggcctcataaaatgagttatggaggattccctctttttctattgattagaatagtttcagaaggaatggtaccagctcctccttgtacctctggtagaatttggctgtgaatgtgtctggtcctggactttttttggttggtaggctattaattattgcctccatttcagaaactgttattggtctattcagggattcaacttcttcctggtttagtcttgggaggatgtatgtgtccaggaatttatccatttcttctagattttctagcttatttgcatagaggtgtttatagtattctctgatggtagtttgtatttctgtgggatcggtggtgatatcccctttatcattttttattgcatctatttgattcttctcacttgtcttctttattagtcttgctagcagtctatcaattttgttgatcttttcaaaaaaccagctcctggattcactgattttttgaagagtttttgtgtctctatctccttcagttctgctctgatcttagttatttcttgccttctgctagcttttcaatttgtttgctcttgctcctctagttcatttaattgtgatgttagggtgtcaattttagatctttcttgctttctcttgtgggcatttagtgctataaatttccctctacacactgctctgaatgtgtcccagagattctggtatgttgtgtctttgttctcattggtttcaaagaacatctttatttctgccttcatttcgttacatacccagtagtcattcaggagcaggttgttcagtttccatgtagttgatcagttttgagtgagtttcttaatcctgagttctagtttgattgcactgtggtctgagagacagtttgttataatttctgttcttttacatttgctgaggagtgctttacttccaactatgtggtcaattttggaataagtgtggtgtggtactgatgagaagaaagtatattctgttgatttggggtggagagttctgtagatgtctattaggtccacttggtgcagagctgagttcaattcctggatatccttgttaactttctgtcttgttgatctgtctaatgttaacagtggggtgttaaagtctcccattattattgtgtgggagtctaagtctctttgtagatctctaaggacttgctttatgaatctgggtgcttctgtattggatgcatatatatttaggatagttagctcttcttgttgaattgatccctttaccattatgtaatggccttctttgtctcttttgatctttggtggtttaaagtctgttttatcagagactaggattgcaacccctgcctttttttgttttccatttgcttggtagatcttgctccatccctttattttgagcctatgtgtgtctctgcatgtgagatgggtctccggaatacagcacactgatgggtcttgactctttatccaatttgccagtctgtgtcttttaattggagcatttagcccatttacatttaaggttaatattgttatgtgtgaatttgatcctgtcattatgatgtttgctggttattttgttcattagttgatgcagtttcttcctagcctcgatggtctttacaatttggcatgttttgcagtggctggtaccagttgttcctttccatgtttagtgcttctttcaggagctcttttggggcaggcctggtggtgacaaaatctctcagcatttgcttgtctgtaaaggattttctttcttcttcacttatgaaattctgggttgcaaattcttttaagaatgttgaatattggcccccactctcttctggcttgtagagtttctgccaagagatcagctgttagtctgataggcttccctttgtgggtaacccaacctttctctctggctgcccttaacatgttttccttcattgttgatgtgtctaatattgacagtgtgggagtctaagtctctttgtaggtctctaaggacttgctttatgaatctgggtgctcctccattgggtgcatatatatttaggatagttagctcttcttgttgcattgatccctttaccattatgtaacacctttctttgacttttttgatcttcgttggtttaaagactgttttatcagagactaggattgcaacccctgctgtttttggctttccatttgccttattttgagcctttatttccattcctttattttgagcctatgtatgtctctgcatgtgagatgggtctcctgaatacagcacactgatgggtcttgactctttacccaatttgcagtctgtgtcttttaattggggcatttagcccatttacatttaaggttaatatttttatgtgtgaatttgatcctgtcattatgatgctagctggttattttgcccattagttgatgcagtttcttcatagtgtcaacagtctttacaatttggtatgtttttgcagtggctagtactgatttttcctttctatatttagtgcttccttcaggaactcttctaaggcaggcctggtggtgacaaaatctctcagcatttgcttgtctggaaaggattttatttctcctttgcttatgaagcttagtttggctggatatgaaattctgggttgaaaattcttttctttaagaatgttgaatattggcccccactctcttctggcttgtagggtttatgccaagagatccactgttagtctgatgggcttccctttgtgggtaacctgacctttctctctggctgcccttaacatttttttccttcatttcaaccttggcaaatctgacaattatgtaccttggggttgctctcctcaaggagtatctttgtggtattctctgtatttcctgaatttgaatgttggcctgtcttgctaggttgaggaagttctcctggagaatatcctgaagagtgtttcccaacttggttccattctccccatcaatttcaggtacaccaatcagatgtagatttggtcttttcacatagtcccatatttcttggaggctttgtttttccttttcattctttttaatcttgtcttcatcctttatttcattaagttgatcttcaatctctgatatcctttcttccacttgattggttcgactattgatatttgtgtatgcttcacaaagttctcgtgctatgtttttcagctccatcaggtcatttatgttcttctctaaactggttactctagttagcaattcctctaaccttttctcaaggttcttagcttccttgcattgggttagaacatgctcctttagctgggaggagtttgttattatgcaccttctgaagcatacttctgtcaatttatcaaactcattctccatccagttttgttcccttgctggtgaggagttgtgatcctttggaggagaagaggcattctggtttttggaattttcagccttttggcgctggcttttcctcatcttcatggatttatctacctttggtctttgatgttggtgaccttcggatggggtttctgtgtggacatcctttttgttgatgttgatgctattcctttctgtttgttagttttccttctaatagtcaggcccctctgctgcaggtctgctggagtttgctggaggtccactccacaccctgtttgcctgggtatcaccagcagaggctgcagaacagcaaagattgctgtctgttccttcctctggaagcttcgtcccagaagggcacccaccagatgccagctggagctctcctttatgaggttgacccctgctgggagatgtctcccagtcaggaggcaagggggtcagacacccacttgaggaggcagcctgtctcttagcagagcttgagcgctgtgctgggagatccactgctgtcttcagagctggcaggcaggaacgtttaagtctgctgaagctgcacccacagccgccccctcccccaggtgctctgtcccagggagatgagagttttatctataagcccctgactggggctgctgcctttttttcagagatgccctgaccagagaggaggagcctagagaggcagtctggctacagtggctttgctgatctgcagtggggtctgcccgatttgaacttcctggtggctttgtttacactgtgtggggaaaaccgcctactcaagcctcagtaatggtggacgcccctccccccaccaagtttgagtgtcccaggtcaacttcagactgctgtgctggcagtgagaatttcaagccagtggatcttagcttgctgtgggctccataagaatgggatccactgagctagaccacttggatccctggcttcagccccctttccaggggagtgaatggttctatctccctggcgttccaggtgccactggggtatgaaaaataactcttgcagctagcttggtgtctgcccaaatggctgcccagttttgtgcttaaaacccagggccctggtggtataggcacctgagggaatctcctggtctgtgggttgcaaagattgtaggaaaagtgtagtatctgggccggaatgcacagtccctcacagcacagtccctcacagcttcccttggctaggggagggaattccccaacctcttgcacttcccagctgaggcaatgccccactctgcttctgctcaccttccatgggctgcacccactgtctaaccattcccaatgagatgagctgggtacctctgtgggaaatgcagaaatcacccgccttctgtgttgatctcgctgggagctgcagaccggagctgttcctattcagccatcttgcccagcaacaaaacttctacttggttaaagttagaattttattcttaaatttattaaacattaatattaatgcttattattaatcacagttctttttcctgaatagcaatgatatcagcagctaatgcttattgacttcttacattgtgctaagccctttgcttatttatctcatgtaagctactcaaaaatcccatattggagatgttattactatccattttactgaaatggagatagctgcttaacagggtttaggaactcacatagtaagtgcgagaaatggtaaaaggtacaccttgctgatgtacactgaattctgtcacattgctggtgaataccactcaatagaaaatatgaaaacaaccacaacatatcttcttcatgatctagcgcaattccagcatctggagagtgaaaagtgtgagaaaaatgaatttagattccagctattccaaatgagaagttgattgttgaagaaacaaacactgaaatgtttgatctttcatcaggggtgtcaatatattacaaatattttaatgttactctaaggaacaaaagggaaaacagaaataatcccttcaccctatgatgtgctaaaaattgagaaatggaagctctcgtttatttggtcaggttacttcctgaaggtgattttgtaagggaaatgtttgtgattgggaaaaggaaattcttattttcttttgtggcatttattcacacatggaataagtgaattgaattttacagtttataatcttgttcacttataaacagccaataagtgggaggtatttgaaaatacaattaaatgaaaacatcatctcaagaactaatattatgtgtctttaatctactgaactttcaattctttactttaaatttattttcatttttgtccaagttatgcattcacatattttaaagagtcaagtactttcacaaggtttcaataaaaaacaaaagttacctgcttcatccactcaaatgtttcccttcccagaggcaccatgatagacatacactgcaatttctgaattttttgttctagtcattgtctatcactcctggtatgaaagatgaagattttgcttttgcaaaatctcaccccactcgtactcctacatatatttctcatcttcatcctcccactgtatttatcatgtgattttgcttagaccatcatttggtttttacatcatactgactctgtaaatcctatttataactaagttgccttatatactatgactatttttttttgcagcattctgtttttcttaaagttagcaatgatgtggtgtttgattgcttagctttgtgtgtacttactactaatacatttcccaattatcctcaagttgtatgtatctctcaggacattaggacaattttatatctctggataaatccttccagagtctgagctgcttcagtctggattgtttgccatctacacctgcattaattatttactgccacaaacttggtgggttaaaatagcacacatttattatttcagactttccatgggttaggagtccaggcacagcatagctgatttccctgtttgggatctcactggattgaaatcaaggtatttgttagggctgaattctcatctgaggctcaggatcctcttccaagctcatgtcactcttggcaggattcagttccttgtagatatgggactgaggccgttggcttctatagaccacccaccattccctgacatgtggtcctcgccacataaatggctgtctgcttctttaaggtgagcaggggagaatctctgatgtttcaaatctctttgactccttccctctatgatttctagactatttttaaaaggctcatctagttaggtaagacttcatcccggacaatctccctattgattagcttaaagtcaactgattagggactttaataacatctgaaaacctcttcattttcaccatataacataatcacaggagtaatatcccatcgtattcacagatcctgcacacactcatgtgaggggattctacagggcacatatatcaaggggtgaaaatcttgcgggtcatcgtagaattctgcttaccattatacctaataactggaagccacccagaactctccattcattatcatcacagagattccctcagcctttctcttgaattgaattctctgtttcctggactttgtgtcttttttttttctcttggtttattccataaatttctagaagcacatcttcaaacagcttcctgaaaaggggctacatgagttttgttttttagacactgaaaatggagttcttgaagttatttttcctcagaatttttagtgtgttgttgcttcattgccttctagcttccactattgttattgataagtttgatgtcttcttatacttgatactttgtatgaaacctgtttttttttctccctgagactttatattgtccattatctgtccccagctttgtgaaattcctcgataatgtgccttggatttggtctactttatccattgttctgggtgctcagtgacatccctttctatcaggacattcatgttcctcatagattctggaaattttattttgaattattttattagtgatttccttttatctattttcactatcctctattcatagaacttcaattattcttttttttttgacggagtctcgctgtgtcgcccaggctggagtgcagtggcgctatcgtggctcattgcaacttctgccttctgggttcatgccattctcctgcctcagcctcctgagtagctgggactacaggtgcccaccaccatgcccggctaatttttttgtatttttgttagagacggggtttcaccatgttagccaggatggtctccatctcctgacctcgtgatccacccgcctcagcctcccaaagtgctgggattacaggcgtgagccaccgtgcccggccagaacttcaattattctagaacattctagataagtctctattttaaaaaatattatctattttcttctctttcttctagtctttctgggagattctcttgattttatcttccaatatatattttttgattttttatgttgtttgagatggagtcttgctctgttgtccaggctggagtgcagtggcaccatctcggctcactgcgacctctgcctcctgggttaaagtgactatcgtgcctccgcctcccaagtagttgggattacaggcacctgccacacgcccagctaatttttatatttttagtagagatgggatttcaccatgttggccaggctggtctcgaactcctgacctcagtgatctacctgcctcagcctcccaaagtgctgggattacaggtgtgggccactgtgcccagggtatcttccaatagtttatgcgatcatattgtctatttctaaggtttcatgttcactggatatttgttttatagtatctacttcttcattgattcatattctctagggatattaatactagttattattaagtttttctttctatttgtattggcatttaaagtgaggtggggtttttttcataaacgtctggcagtccttggctgtctgctcatatttaagagtgaggcaggcgctaaaaagaaggctgggagctcatggcagggggagtgcttctcaatggtgctcttctctctaggataatatttggaaaacttttgatttgagtgtcttgtgcttatttctcttggaagataggttctcaaagaagatgcctttgaccccctccatagaagggggagaatgttttagaatagttgaaattctatgaatagaggatagagaaaatagaaggaaatcagtagtaaaagatttcaatataaaatttctagaatttaagaagaacatatatatctggctgccaacattactgagctatatgagggaagatggctagagatcttaggtcctatacataaggtttatcttagtccccatgttttctgtttggtatctctgttttagttgtacctggtattgcctaattcaaagatcatctgtttatcatccttagagaataaacttcaagtctcctgccagaatgggggatggatatttgttcagatgtataaatttggattggagatatgagggactaaatttttaaacagtctttcaactgattattccacctgccaaatcctgcttctttgtaggagtctgcaatgtacattaggttatttctccccttttccaacttccagattaggattcagctttctcatgtctgttaaatcatttaacccctaccatctgtccaccaacttccaaaatcgtgtcactgatgtctcctatctcatactttgttctcatgtatttatatcttctgtaaacattcctttattctcatttagtgggattctgggagggagaagagctaagtgtatgttcaatctaccatttttaactattcatatgcaagacaatactcaccaaagccccaatgagttttttgaaaggaacatcaccagatgatttgaaagcctgcctgaaggaatacacttgtgagaaagccaagaaatttctgggagaatatataatgggatttccccctacaagatatcaaaatgtattttaaatatatagtcactaaaatggaatcatattggtgattacagacagattaatggaacaaaaacacagcagaccaaagacattcttatatgatcacacaatatttcaaattagtaagaaaagaattaaccaggtaactaatcagctgataaatgatattagaacaaatgactaacaatttttcaatatatacatataacatcagaacaaagtttggggatctggtctccttcctagggtctaacaagagtcccaggggatgacaaaaactccaagagtgtctttcagtgtgtggttgtaactatgccatttttctttgctctggctcttgtggtcctcctgaaggcagctggcttttctgattcaatccctccactacacacacatgtacatgcatatacacatgtgcatgtacacctcctcctcccccagcagatcatgacagccttaactgcagtttccaagctcactgagcttagtatttggttgccagccttatcagaggtcccgcctcttccccaaagccagattgagagcagggcaacatttccactgctctcacaactccctacccttatctactgggattagaaatcctattcctggtggactagactgccacctcactgcttgaaccctctgagccttgatattattcaccctgtctggaaacaagggcctcatatctgtccttgaagcaaaaaactatccacacctccagaagaggaagccctggtgttacagttatctcatcctgattaacaaatcacgcccaaactttccaccttaagcaatgacatttttttttttttgctcaagaatttgcaatttggggctgctcaaaggccgaggactaggatataaaatcatctagaggctagttcactaacatttctggtggctaacgctggttgccagctgggggtctcagctagtgctgttagtcagagcacacatggtctcctcatgcagttgaggcttacttatagcatggagcctgggtctcaagggtgagcatgccaaagagggagagccaggtagagccatattgctttataggacctagctttggaagtcatgcagcatcacttccactctaatctatttgttgaccagtctcaaagttccactcaggttcaagggagaacaaatagattccacctcttgatgggagggtggcatggttctggaggaacatgtaggactggatagattgctgcagccatttttagaaaatatcatctgccacacctggctcactatattaaaaagaagaggaagaaactgaacaaaattgagaaaaaaaatctatagaaagaatcaacgaaaccaaaagtttgttttttgaaaggataaacaagattgatagactactagctagatgattaacaaagaagaaaagaaaatccaaataagcacatcagaaatgacaaaggtaacattataactgaccccacagaaatacaaaagatcctcagagactattatgaagacttctatgcacacaaactagaaaagctagaggaaactgataaattcctggaaaaacacaacctcccaaatttgaatcaggaagaaagtgaaaccctaaatatatctatatcaagttccaaaattgaatcaatcataaaaaagcatattaaccaaaaaaagccccagaccagatggattcaaagctgaattctatcagatgtacaaagaagagctggtactaattctactgaaactattccaaaaatagttaccgatcactaactcattctacaaagccagcatcacactgataccgaaacctggcaaggacacaacaaaaaaagaaaacaaacggccaatatccctgatgaacataggtgcaaaaatcctcaacaaaatactagcaaactgaatccaacagtgcatgaaaaaattaattcaccatgatcaagtaggcaaaatccctgggatgcaaggttggttcaacatatgcaaattaacaaatgtgagtcaccacataacagatttaaaaacaaaacccatatgatcatctcaataaatgtggtaaaagctttttataaaatccaacacaccttcatgataaaaatcttcaagaaactaggcatagaagcaacataactcaaaataataagagctatctatgacaagtgcacagctaacatcatactgaatgggcagaaatggaaatattccccttgagaactggagcaagatgagaatgcccattcccaccacatctattcaacataatactgaaaatgctatgcagagcaattaggcaagagaaagaaataaaaggcatctaaacaggaaaagaagcaagctatctctcttcacagatgatatgattcgatacctagaaaactcgaatgactctgtcaaaaggctcctggaactgataaacaacttcagtaaagcttcaagatataaaattaatgtacaaaaatcagtaacatttctatataccaataatgttcaagctaaaagccagatcaagaatgcaatcttacttacaatagccacacaaaaataaaatacctaggaatacatctaaccaaggaagtgaaagatctctacaaggagaactacaaaacactgctaaaagaaatcacagatgacagaaacaaatggaaaaacatttcacactcatggattggaagaatcaatatcacttaaatggccatactgcccaaagcatactgtagattcaacactattcctatgaagctagcaatgtcatttttcacagaactagaaaaaaactattctaaaattcatatggaaccacaaaaagcctgaacagccaaagcaatcctaagcaaaatgaccagcatcagattacgcgacttcaaactgtactataaggctacagtaacccaaacagcatagtactctacaaaaatggacacagaccaatggaacagaatagtgaatccagttataacacacctagagccatccaatctttgacaaagtcaagaaaaataaggaatgggaaaaggactccctacttaataaatagtgctgggatagctggctagccacgtgcagatgaatgaaactggatctgtacttttcactatatacaaaaactaactcaagacgggttaaagatttaaatataagacctcaaactataagaatcctagaagaaaacctaggaaacaccattctggacatgggcgttgggaaagaatttatgactaggtcctcaaaaacaattacaacaaaaacaagaattgacaagtgggacctaattaaactaaagagcttcagcacatgaagataaactaccaacagagtaaacagacaacctacagaatgggagaaaatatttgcaaagtatgcatctgacaaaagtctaatatccagaatctataaggaacttaagcaattgaacatgcaaaaaacaaataacccatcaaaaatgggtgcaacacatgaacaaacacttataagacataccagctgccaacatacatataaagaaaggctgcatatcactgatcattagagaaatgcaagtcaaaaccacaatgagataccatctcacacaagtcacaatggctattactaaaaagtcaaaaaaacaaccaatgctggcaaggctgcagagaaaagggaacacttatagactgttgatgggaatgtaagttagttcagccactgtggaaagcagtttggagatttctcaaataacttatgacagaactgcctttcaacccaggaatcccattattggacatatatccaaaagaagacaaattgttctaccaaaaagacacttgcactcgcatgtttatcacagtactattcacaacatcaaagatatggaatcaatctaggtgtccattaatggtggactggataaagagaatgtggtacatattgtgggaaagagtttctggggtgccagttgagttggtctctcctgtgtgagacacccatgggaagccatgggtggcctctgaggagaaaagtctccttactgccttcatgtctttatgccccaagagcataaccgctcagtggcattccacaggttgctcggggagataacactcccttgaagcagtggagtacaatcaaacatcttggctcctcctgaaacccgctcccacccatttcagtccccataagttaaagatcttaagtagtttagacacacgcctttgctcaaggaaattcaaagaaaccgccactgctatacatcttattgaatgactcacgagttctccttcactgattaatccttttcctcatcccttcctccccctcccatctgccctaagaacaaagagcttgtaaaccaataaattgggcggagcccgagagctctgggccatgagcaagcctccgagggtccggtcccctggacctgccttttaaacgcttattctgtctctttctaactcctttgtctccgcaggactcggggtaccccctgggtggtgtggggctggttccccaacacatatatgtcacagaatactatacagccataaaaagaacaaaattatctcctttgcagcaacgtggatgaagctgaggccattatcttaagcgaattaatgcaggaacagaaaaccatatactgcatgttctcacttatcagtgggagctaaacattgggtactcatgaacataaagatggtaacaatagaaactggggactactaggtggggaggaagggagggatcaagggttgaaaaactaactattgggtactgtgctcactacctgggtgacgggatcatttgtactccaaccctcagcattatgcagtatacccaggtaacaaaactgtacatgtaccccatgaaactaaaataaaagctggaaaaacagaagaggaagaaaaaatgtttcctttgtttttgtgcattaaaagcccataggcaagaaaatatacagttaatttctcaattaggctaccctgcccatctggtttcatggttgagagacaaatgctaatgaatcctttggtacatcaattaactctgctttgcttcaaggtcatggattaggtccctacatcgagtcagtcaccttgaaaacaaatgatactgcgaacaaggacaaccagacatccctcacaccccgccaaatagaatgtctcggtgtaaatcctttactactggcaaatgatctactaaagagacatcttctgtgcctaaaaatgggcagcccataaacatttacagtgataggagaaggaaattattttcttttttcttttcaaataaatcatttgcacattaccactctattgaactcatttatagaaaacaagatcgcgtttttgttttgttttgttttgtttttgtttaatgaggaacaaaccatgttactgttaaaatgcaacattatttgtcttggcaactacatttggataaatctttatggaggctctattgtttggttttctatcattgctatactttttaaaaatgtgctcgtgaacggttagcaattgcctatcacagtgaacttttcctttgggaactggggatttctgacacacagaactgcatttcctttatattgtgttacaaatacttgataattcaaaccaaattccaggttagtcttagtaaaagacatgcccaacaaatggctagtttctaaaattcataggtgatatatttgcatctggagttggtagaggaagatgtaagagcaaatcttgcatgaagaatagtttagagaaagcttgatttagttatatcctttcttgttccaaataacatttaaactaagtaagcaagctttgtacaatctactaaggatttttcttaagaaatgagtcagaaaataatttgctaataactttaaatatattgtgaacaagaagcatggctcaattaattcccagatcttactttgaaaaatggaatttcctgagagacttgttagaaatatagattcccagggctacctttaagaatttgagtaagtctggggtgacactccagaatctgcattttaaacaatgcccccatgtgaaacggatacaactggacctactaacctacataaaattttatttttagtttttagcaatttaatagaaaactcttactctatgtaaagcaagtattaactcattaaatcctcataactaactaataatgtagggatattgttcccagtctacagatgacaaagctaaaccacagagaggtcaagtaacttgtccaagggcccgcagctgaacccaggcaatgtggctccagagtctgtatttggttgacttttaagagacttaatcacacatacataaaaataaactatataaaattaaatcagcatgtcgagaagaacaaaaataaaatatataaaatcattgaactgtaggatcaatgaccaaaagtctagaggttgtcagcttccctctttctcagacctttgtagctggagttactatagacacaatgctaccaaatttctgagacaaagtggccatacagtatcaagtggtaccaccaagtcttaccaaaagtgctactcaattgttggccattacaattcccataattaccattgtggcaatcatccttatcctttgaattctccactgggactgcctggagctcttctgtgatccacacttggctggcattgtcctagccattgacacctcttgccaactttgtccctgagtggtgggtgtcatttcccataatcccataactactgcctggggtccttctctaagggactcatcatctaccaccacaaagtctgtccttctagtgtctaacactctgaccctgcagccagactacattcctctggccacaaccatggtccagaaccaaacccacatcttttttagacttgacatcctcaacctcacactagcccaatgcctcagagcactcaaattcagaaataagttacgctgctccacaaggatgctttatgggggtatttcacacccgaatatctggaatatgttgatatataactatacttacttgttatcagatctaacatgaccctttccttctctgaaaataaaaaaagccaaaatgaaactttaaatttttaaatttacatataaataatttatgatgcctttgaattagacattttcaacttttgccttaaacagatggggtctgtcggatcccataattttgtttcagaagtttaacttcatgaattgactttatatgaaatatttataaacatcagagatgtggtatagaagatagactcattaaggtcctttttttttttagctcatcaagaggtgctttagaaaactaggacttgttcttagctgcacatggagtatgaaaaggtataaggctaaatgttttattcctcaacatgtgggtcatatataatcaatttgatattgtgtttccttggttttattgcttaattgtatttatatatcatggaaggcagcagaaagaaaacatgtcaattagccattctcacaaaaaaaatttgaagagaaagatgatctgtcaaggtaccatggcatggtggaaaatattattgtcaatggagtcagagagatcagggcaaaaattcaagtttgcaacttcgaaagtttttagcttttcagaaccaagtacaagttaatgaccttattgccatactataaataattcccagtagagaagctggcaaataggcctcactgaagaaagttaactggtttcttaaaactgtgctttgaaccatagaaaaaaatgggagcaggtacatacggaccctaccgtgtgccttttccaaatgtctaaattttgtattatgttattatattaagttatttggggatctaataagctggattgggtcattttagtatttgagatcgtgttaggcgagcaaaagggagagtaattgtgctgtggatgtgaaatgaaagggtcagattagttcaagtcatctctcatttgctggtatactccatcaagaggttaggagatgacaagttgccatgggtgtgaatctccaattgaaccaattaactccacctaattcagagcctcagatgtgggtaatggaggtatagcagaaatactgaactgattacattgaagaggtcaccaagggaagactgcaggggaaaatttatcctgcaagcggaaatccacaacaaaaacaaggaacctgatgacaagtcgacctggaagactcaagttcttacagtaattttgagttttaagttctccctcaagctcatgacttttcacttcatttaagtctactcaagtaactgaggttttgtcaaaggtcaccagtgaaaccttggtcaccaaactcaaaagcttcgtttcaatacttttcctctctcaattcagcggggcttgcctctgctagacacgtcttccttcagaagcattcccttgattctacgacaagtttttactgtaagttcccacttccttttttgtccctttcttacttgttttattcccttcttttcacctcttcaggtttctaaatgagggcacatctcacagcttagtttttggctctcttttattaatatttactagcttttagttagtacatttacacctttggctgctacttttctatttcaaatgttaactctgaagcatggttgaaatttctaaactccttatacacatctctaacagatgtcccactggctcctgaaactttgcatcctgcctgtattagttggttctcatactgttataaagaactacctaagactgggtaatttataaagaaaaaaggtttaattgactcacagttctgtggactgtgcaggcttctacttctgggaaggcctcaggaaacttacctgagaagagaagacaagggaagcaaacaccttcttcacatggaggcaggagagagagcaaagggagaagtgccacacatttttaaaccatcatatctcgtgagaactcagtcactgtcataagaatagcaaggggggaaacttcctcatgatccaatcacctcccacgaggcccctcctccaattcgacatgagatttgagcaagaatacaaatccaaaccatatcaccgccactcttcttatattctctaacccatgctcccaaattccccaacacagctcctctcactcaagttgcccaggttcccaaacttggaatcacctgggacgttgccttgtctttcaccctcttaccttaagaggtgctaattactacagattctgcccgccaaaatcatctaggtctgtgccattcatctgatccttccatagacgctctgtgttaacattacatcatgcctggagctaacacatcccaagagaaatacaggccaaatgtactgggagtccagaggagattattaattcttaaatggaccattcatgtatctgttccagatgataaaaggcaaaaaacactgaatgattaccaatccaaggaaagtcacccaaaagtgtactgaaagactaaaacgaatgttgtgtcttaaatagaagctaattgttgtagaaagaatgatctttacaaataacagggctcttttaaaaacagacagagcaaaagtttcttccctcccctaatcagtcaatggatggtaatgatatgatggcaacataagaacataaatccatttttccaggtggtttttatggaccttctgaatcagaatcatctggggtagctgttaaaatgctgtttcccaggtttcatcctgtactcttcttttgtagtgccctgggacatccttttaaaacaagttatccctatgattcttatgtacattaaagcttaaacgccactaaaaaataagcaagagaaaaggtcaattacatcaaaatatgataaattacattttttatacttgtctctagttttcaaactttatagttatatcagaaaaaataatgagtaattttaaagtttctagtctctctctggattttcactatatatatcagagaataactcacagataagttcttttaaataattaagaagattctgtaaaaggagaagatatttgaagcagaacttttccatacattttcaaaactactgttaaactcaagagtgacctaaataatctaatgtttttttaattgaaaaagtttttaaaattccagatatgtaggaaaaagataataaaattatgatactattgttcttttttcaaaactcaagttctcttgctaattgttaaggatactgatttatttgaaacacaacatgtttctgcttcataacaacatgtgtattattttacatttttattggcaactttcactgtaccctggtgatttctagaaatccgcatacttccctgctgctaaaagtttccaaaaaataataaacaaatgattattaactcttgatatttttattctatgatcatgtactttataagaagcacttgaaaaagtggagctattaactttagggaaaatagggtccatataccagatctcaactgcagggatattttgttaggtagacagaccatcaagagtagatagaaaaacacccaccacaagtgtattattcccaagaaagagtgtcagcatttggacttccttccgttagcactaaacacactcctaacttttcacctcatgaaaggaatgtcccctgctcatagtgaagttgctatcatggccagtgttgctttttgcacaagtgtctagctcagtggttctcaactgggggtgttttgagcccccaggtgacattttgtagtatctaggtttatgtttaattgtcacatcttgggaaagctactgacatctagtgggtagagcccagggatgctgctaaacatcctacaaagcacaggacagcctcccacgacaaagaaatttaaagtccaaaatgtcaatagtgccaaggttgagaaaccctgggctgaactcagagttccataaattagtgcctatttccataaatttttaggtctgtcagttcctgcttcctgactttctaccctaatcatctgaagcttcagagtttttcatatcaccatattaatggtgactgatctttttgatacctctcttgacccatatcctcaccccgatccttgacctaaccctgtccatccggcagttttgatccttctttatcatctgaaacctctattcagattatttgccatagaattgtctgtccctctctcacacaagaataatcttcttgagtgtgagaactcttaccttagtctccccagcatccatcatggtgcctcaaacataacaggtgctcaatgaatacttgtcaaactaatgaaataagacttgcattgtaccaaacactgatgatgactcacataacataaaacataaccatttccttcaagtacttacatttttgggtgaaggtacacaccagaaaagatagctagcactgtaaaacagtgcttaatgagtaacagatgtataattcagacaataattactataaaagatttctggtgagtgtgagttcccttagaatgcagggaagcagagagtgcctcatcgaatcgaaaactgaaatatacttgaaaggatgaggatgctttgtataagctaggaaatgtggggaggccattccagcctggtgagatgagggtggaaagtagagcataagcaaagcttgtctttgtagaagaattttgccacatagaaccatggcatctaaaagcatgttcatggggtcctcttttgtacttctcacatagtattccaagaagggggagcatacagaaaagcagtggtagaagcccagatgtcatccattaccctagatcacactccctccctggaaggagctcaaatccagtgactgtcaaatagagagggatccaaaagcctggcccccttgcctcaaggcaggacaactttgaagagccatcccagtgctaaagcttcctgacccatgaccattttaactcctccctctttctcatccttccatccattgagcattctccaataaattacttgcatgcaaatttccattttagagtctgtttcctagagaacccaaccaaaggccacaggatgggaaaaacaacctatgctgatggcagttagaaagcttgtggcctgacagcttttaaaactgtccctcttgcacactcagcagttcaggccattgtaagtaggtaaggagtaactggtcaaccttttcgcttactctacagtatctcacttcactccccactgacccctcatatccctaggaattttccccacccaccctttaacaagaccttctctgaaagccttcatcatgggggctaaatgactcatgatactttattctcacctaacaggaattaaggttgtcattcaaccttgattcaaactggataaaagaatcagcttgccattagagactacttggggaacatgagggacctttatggtgccataccacagtgaactacatggtatcagagacgatgctatgaactcaccaaaccccattttcttttttgtcctcctaggagaacaaaacatgtcctcaatgttatagatttcccagccttctctgtgatgcaactaggccatacgactgaattccgagacccacataatgtgggtagaagtgatgcctgccacttctaggcctgttcccttaccgcgtccccacccccgaccccccatacacaattcttcatgctcctttttactttttctaccatttgtttgtagttaatccagttgaatcctaaggtctcagggcatggagccataacatgaatggagcctgagcccctgaatggctgaatgcaatagagcctttctctacaccataacaaccatgcttgggctatgccagagatattttcatgtcacctggatcctagaaaattcaagaaaaagaaaagacttctttgccattataggtatagcaagtggagataatgtaatcaaaggcataatcacttacaaaccaacaaacaactggcatcctatatttagctatggaagatataaatggatcatgtaattatattcacccatacatattacacaccattgcttgtgtgttaatgtgcttaaattttgtttcaaaaacaaaatatcctactgtgatgctctgagtaaacagattcttagcaaaattaatgaacaatgcctgaaaagagaaaacttgaggaaaatgaaccaagattttccctgaaaagtgaaaaataggaaaagatataaggttggttggataaatatagaaattacacgaactagacatttaagaagtgtgttattttaaaggtcaaaataaacaaagcatgatatatattaactcactattaccatgctttctagatgtctatagtccatacttggaaaagaaaatagccaagtgaaaacaggatgacttgcttttctcttttaagcaattattcttttctgtggaaggatttagctatgcttcaattctctggagggactctatttaaaaaaaaacaatttatattgttatacttgaaactatcttcacaaagggctcaaatttgaagtagtagaaaactttggtttcaaacctataaatgcaactaattttattctattctaaattttattatcaaggagcacattgcatattttaagtcattctggaaggaggtttccaaaaaatctttctgttcataggagaatttgctaaacagcaacactttcagccactcactaatatctgagcacctcctacactcattagtgattcaatccactgtgtgttcatgtgtgtgtgtgtgtgtgtgtgtgtgtgtgtgtgtatgtgtttctcatcattttgctgcattggaggcagttttatgcctccaatttttaatttttaatttttttgcatacatagtaggtatatatatttatggggtacattagtcattttgatatagtcatacaacgtataataattacatctgggtaaatggagtatgcatcacctcaaacatttatcctttctttgtgttacaaacagtccaattatactattttagttatttttaaatgtataatatattcttgttgactgtagtcaccctgttgtgttatcaaatactagatcttattccttctatctaaccatacttttatacctattaatcttcccctacttgcccctccacccacccacccactacccttcccagcctctggtaaccatcattctactctctatcttcatgacttcaatggttttaatttccagctttcataagtaattgagagcatgagtttgtctttctgtgcctggcttatttcacttaacataatgaccttcaattccaaccacattgttgcaaatgacaggatctcattcattttcatagctgaagagtagtctattgtgtatatgtgccacattttctttatttactcgactgttgatggacacttaggttgcttccaaatcttggctattgtaaacagtgctgcaataaacatgggagcataggtatctctttgatatactgatttcccttctttgggggtatatacccagtagtgggattgctggatcatatggtagctctatttttagttttctgaggaacctacaaactgttctccatagtggttgtactaatttacattctcaccaacagtgtatgagggttcccctttctccacattctcaccagcatttgttactaccttacttttggataaaaaccattttacatggggtgagagaatatctcattgtagttttgatttgcatttctgtgatgatcaatgatgttgggcaccttttcatatacctgtttgccatttgtgtgtcatattttgagaaatggttctttaaatattttgaccatatagagttgtgtgagctccttatatattctggttattaatcccttgttagatggatcatttgcaaatattttctcccattctgtgggttgtcgctccaatttaccagttgtttcctttgctgtgcagaaggtttttgacttgatgtgatctcattgtccatttttgctttggttgcttgtgcttgtggtgtattaatcaagaaatttttagccagaccaatgtcctggagagtttccccagtgttttcttttttattcttatttgcttttttcttttaagaattctacatgcaggatggcccccaacattttcttgtagtagtttcatagtttgaaatcttagatttaagtctttaatccaatttgatttgatttttgtatatgatgaaagataggaatcaagtttcattctcttgcatatggatatccagttttcccaacaccatttattgaagagactgccctttctccaaggcatattcttagcacctttttcaaaaatgagtgcactgtaggtgtatgtatttggttctgtgttctctaatctgttcaattggcctatgtgtctgtttttatgccagtaccatactgttttggttactatagctctgtagtataatttgaagtcaggtaatgtgattcctccagttttgttctttttgctcaggatagctttggctattctgggtcttttgtggttccacataaattttaggattgtttctcctatttctgtgaagaatgtcattggtattttgatagagattgcattgaatctgtagattgctttggataatatggacattctaacaatattgattcttctaatccatgaacatggagtatctttcaatttttttgtgtccttttccatttctttcatgagtattttatagttttcattgtagatatctttcacttctttggttaagttaattcctaagtattttacgttattagtgactattgtaaatgggattacttttcaatttctttttcagattgttcactgttggcatttagaaatgctattgatttttgtatgttgatcttgtattctgtagctttactgaatttatcagttctaataatttttggtcaagtctttaggtttttccaaatataaggtcatattatcagcaaacaatgataatttgactttttcctttccagttttgatgccctttatttctttcacttctctaattgccccagcgagaacttccagtactatgttgaataacagcagtgaactgggtatccttgtcatgttccagatcttagatgaaagacttttagtttttctccattaagtatgatactagctatgggcttttattatattgaggtatgttcattctatacttagttttttgagagtcatgaagggatactgaattttatcaaattttttcagcatcaattgaaacagtcatacggtttttgtccttcattctgttgatacaatgtatcacattgattgatttgaatatgttgagccatccttgcatccctggggtaaataccacctggtcatgatgaatgatctttttaaggtatggttgaatttgatttgctagtattttgttgaggatttttgcatcaatattcatcagagatactggcctgtagttttctctttttgatgggtccttgtctgactttagtatcagagtaatattggtctgatataatgagtttggacatattcctcctctattttttgaaatagtttgtgtagggttggtaatagttcttctttaaatgttttgtggaatttggcagtgaagctattgagtcttggactttcctttactgggagacattttgttatggcttcaatgtagttacttgttattggtctgttcaggtgttttatttcatcatggttccactttggtagtttgtatgtgtctacgaacttacccatttcctctagattttccaatttattggcatatagttgctcacagtagccactgatgatcctttgaatttctgtggtatcagttgtaatatctcttttttcatctctgattttattttctccctttttttgttcactagtctggctaaaagtctgtcaattttgtttatcctttcaaaaaatcaactttgtagtttgtcgttattttatattgttttcttcattttgaattcatttatttctgttctgatttttattattccttttcttgtactaatttggggtctggtttgtttttgcttttttagttctttaaaatgccttgctaggttatttatttgaagtttttcttcttttttgatgtaggcatttatagctataaatttccctcttactactggttttgctctatactataggttttgccatgttgtctttccattatcacttgtttcaaaaatcttttcaattttcttcttaattgcttcattgacccactagtcattcaggagcatattgtttaattcccatgtgtttgtatagtttccaaaattcctctttttgttgatttctagttttattccactgaggtcagagaagatgcttgatattacttcagttctgttgaatgttttaagacttgttttgtgacctaacatatggtttatccttgagaatgatccatgtgccaaggaaaagaatgtttattctgcagcctttggatgaaaagttctgtaaatatctgttaggtccatttgggctatagtgcagattaagtctggtatttctttgtttagtttctgtctggatgataagtccaatgctgaaaatggggtgttgatgtttctggatcttttattgggttctacctctgtctttagttctaataatatttgctttatatatctggatgctccagagttgggtgcacatatatttataatctttatatcttgttgctagattgacccctttatcattatatgaggaccttctttgtctctttttatagttttttcttgaaatctgtattgtccaatataagtatagctcctcctgctcttttttggttttcactgacatggaatatctttttccatccctttattttcagtctatgtgtatctttacaggtgaagtatgtttcttataggcaacagataatgggatcttgtttcttcatcctgcccagggcagttccagtaatgctgtccaagagctaaggcctggactcagggactccaagagcctgcttgttgctctactgcaaggtgaccaagctggtacctaaggtgcaaaacaaagtcccctttacttggagtctttccttgtagccaccacagctgggaacatgctaggtcacacctacagtcagcacattgcagtgcccaaggcccacagtgtactacctgatggttgctttgggttattcatggcccaagtctctttagtcagcaggtaataaatcctgccagcactttgtccttcccttcaaggcagctggttcacttttggccccaagtgtgtctagaaatgttgtctgtgtaccagggcctggaatggggtcctcatgactctgcccagtgccctatcctactgtggctgaaccggtatctaagatgtaagacaaagttctctttactcttcactctcctccccttaagcaaaaggaaggggacactttcattgctgcaagtttcactgcctggggtttgaggaaaagtggtataagcaatcctttagctatcccagctggtatctccctaggtcatgtgccaccctagtcctccagctctgagtccagcccagggctaagagttgcctaggaattgcaggccttttgccctagactgctatcaagtttacctaggaccccagagcactttggcctgatgtggcaagacttgccgagaaacttgagttcagaccaatagaatgggaaattcccctctggctaggtctagtccaaatgctccctccatgcacaggcaatggctgagcccaacatggctttgctctctgctatgacaaggcagcactgagttcaatgcaaagtcccccagacactgtgctctccctccccgaagatcacagactctctgcactgcacagccactggcagaagatgggagagtggtggtgttggtgatccaagactgtctctctgaccctcttcaatgcctctttcaatgatatgaagtcaaaaccaggtactgtgattgcccacttgattttttggttcttgcaatggttcttttctgtgtgcagatagttgttaaaatttgatgtttctggtggggtacaaaccatgtagactacgattctgccatcttgctccaccccctctgagttctcattactcattattggcctttcaggttttagattttttcatggttcaatgttgctaggttctatgtgtctaggaatttatgcagttctcctaggttatccaatttatcgacatatacttgcttatagcaacctctatgagaaatttaaccttaaatttctgtgggataagttgtaatgtctcctttttcatctctgattttatttcttttggtattatccatttttttcttagtctggctaaaggtttgtcaattttgtttatctttacaaaaaaccaactttttattcctttgatcttttgcattgttacttcatttcaatttcacttatctctgctctgctctttattatttccttttcttctactaattgtgggttttgtttgcactgcttttcccactcttcccaatctctccctgtggctgtcactgccccaggcctgtgacaaatactgcctgactactgccaatgttcattcaaggtccaagggcccttcagtcagcttgtggtgaatgctgctggcctgggactctcccttcaaggcagtgggctcacctctggcccaggacagatctagaaatgccatccaaaagccaaggcctggaactggtgactccacgagctcccactgtgtccaagcttgtacctaggctgcaaaacaaagtctcctttactattccctctccttttctcaaaaagaaggagtccctctacacagtcaattcagctggtaatgtgcctggttacatctaaagccagtacttctctgagtccctcccaaagccgacagcaaatactacctgggtactgctgctgattatttgaggcccaatggctctttagtcagcaggtgattaatcctgcctggactgggtccttctcttcaaggcccagggtgtatctagaagtgttgtcttggaggtaggtcctggaatgagggcttcatgactctgcctggtgctctatcctactgtggctgtgctggtatccaagttgcaagataaagtcatctttactcttccctctcctctcttcaagtagaaggaaggaatgccttccagatttgcaagctgcactgcctgggtttggggatgaggtggtacaagcactcccttggccaccccagctggtgtctcactaagccatgtgtccccctccaaggccactggctctgagcccagcacaccaccaggacttgcccaggaattgacttcctgtggcctagattgcctttcaagtttatttaaaaccccagagcactttagcctgcagtggtgaggcttgccacaactaaggtcccagttgctgggatgggtagttcccctctggctagggctggtctaaatgctcaatctatgagccactgtggtagggcagcacagaattccaatgcaaagtcccatgatcactatgttctccttcccccaagtgcacagattctctttccatgccacgcagttgctgctgagggatgcgggaggagtggtgttagcaattcaagactgtctctcctaccctcttctgtgcctctttcagtgatttgaagttaaaactaggtactgtgatcactcacttgatttttggttcttatgaaggtgcattttttgtgtggatagttgtccaattttgtgttcctacaggaaggacaatcagtggaggcttctattcagccatcttgctctgtttcctcttttatgtgtctttttatttggaatcctacactgcctcagggcaaaaaatgcactagataggctaagacacaatgaatggatattcaagcagctatacatataaacttaagtttatatttctggtagtatatatttatgccctgtaaataaaacgtgttgataaattctatttctcttgatttatataaaaatgcaaaaaatatgatgcatttataactgcagcatcgtcaagtatatttctgactgaagatgactctaagtaggtatcaatgagaaccaaatccaatgcatacaattttacacatctaacgattagaaagattgtccacagacaggcttctggctacatacatttcaaatcttgcttttcccccactacttgcatactttggtgacaagtaacatggggcacactcaggtcacaatacaatctctggtctcgtgcattgggtcacaacacagggtggctcagcaccgtggacagtattcctggaagcctttcctacaccagagcaactagtcataacatacacagaagtgactggtaatcaataagtatattccaccaatgaactgtgcgggtgtcaaagtgcatgttcctgctgggaattttaaatctgtatctttcatctatgagtaaagataattgaaagttattttatatccccaacttaactttcccttagttagatcccccaaaagcccacagctgctcaaacatctctcattttgaagggaagtgtgatggaggggcttttgaaacgggaagggacaacagtcttagtcaactgtggttaaattatctcactttttcaagttttacagaaaaaaatatgaagacatccccagggctcctctcagcattctggaaggaactcatccagtagtgggtcctcaggcttaagcttcatcagcttcagggtgttcctacttctacatatgggttttctttatttccttataaaaactttgtattatggaaattttcaaacatatacagaagtcatgatgatatataattactcaccatatacttattactcagtttcaacaactatcatctcagggcccttcctatttcctccatgaccctgtccactcttctcttccctccccacaccacaattattttgaaacaaaccctacacttacatttcacctacaattatttctgtacatacatgtttaggtttatatttcttatatggggttttatgccaaatctatcagtggccataattaaaatgaatgttttgacttttacaagaattatatttatttctactattttcataacaggaaccaaatctattcaacactactcacttttaacatttacaataaagatgagtgctcactttgacagcacatatacaataaagatgagatttcatttgaactgacaatgaccttttttttcacaataagctgtgaataaacttctgttccatgaacccccatgtgttttatttttatggctaataatagtcgttaatcaatcatcacacatatatacatacaaatcacacagaaagacacatgtaatttttcttcctgtatctcacttctctagcctaaactgaactagagtcttcaattatgggtaaaagtctgtaaaaaaggcattagagaaagaaataagaaaaatacaaaaaagtcatctaacctattaatagttaaaggaacttaggccacatcccaccccacacgtgcagatttttatatcacagtttgtttgttattatatcaccatcattacatgtcatgccattttcatacatcataaaggatacataaaataaaaatattttaaaatctaattactagcattttagtcaaagttgagagaaggaatttaagttggtacctttagttcaaggagaaatttatatgatttcactattctcactagtaaaataaagtccgttgggacacactgccttagggaattttcctttagaaccataaaggctccaacatgcgaaaaaaaaaatagtattttaatatgttagagagcattggtatgtgccttggctcaggaattgctctgatattgaagagttgtgataaattccttcgcaatttcagagtataccctaggcttgaatccaagaattctggggtaaacaagacaagcatggttcctaccttctcagaacttatgatctactgaaacagaccaccatgcgaggaagcacaataaaatgtggcagttactacagcagagtgattacaggggctttggtagtgcagagtaaaggagatgaatcaggggtgacctgggaagtgattaaggtgatgaagctgagactcagggtattattgttgagatttcattttagtgaaaggatagctctgtgcagaggggaggagagatgagaggagacaatgtcagggcaggaagaacaggtataagactactgccatgagtatgggcaagggaaggtggcaccccacaccagggcagtggcaaggaaaatgggaagaagtggacagattcgagagccatttcagagttaacatccacgaagtttagtgacggattagtaggagtgggaagaaaacagggagtactggatatgtgtcctagaagggaaagtggcaatttttgttgtgtgaagttggacaaggagttaagctatttgacttgtatattcctatttcagttgattctccagagacagacaaacatctcaaagtagagctcagcattgcacttcatgaaattttgaagaatgtgtgcaagtggtgtaattactgttataatttaatggggctgctttgtgccttgaaagctaggaagcaagcatgcctttgtgtgttcaaaatgctaattgaattatctctgactttagtttatgttccttaagtacaaactcttaagtcaggccaaagggatcacagctatgttgtaccatacttaactaccttttttataagcaaggatttttattccaaaaataaacagaggcatactgacataaacccataaagtatgtgggctggtactttaaagaactatgtatttgcacaaggaccaggagagctttcttaaaagggaccaggtcctgggaattctctctaaaagtgatttatttctgtcaacattcttcttcaatttaaacatacacattcacatatatttaaattcctccagacatttgagtttaaagttttactcctgatctactgagtaaatacctttagcaaataggcaataaattaagtgaaggcagctttctttttgaatataccttcctcatacaaatctccatctaaacacctaaagatttgataatatttatttcaagatatttcctatatttatatatgtattatgtgtgtatatatataacatatatattagaaaacgatggaaatgtctaaaatttgctgtttttttctcacagaagagttttcttcagctttctgacaatgtagatttcaaactttatagatgtatttatagaatcattttcaacaaacatttgttaaacacctactctatataggtggatgcgctagtgtatgtcaatgtgtatcattaccataataagtcaattgtcaaaaaaatcagacaacttaactgacaaataataatattaaacaacctcatggccacaaatggaaacagacttaggtgaacactttctacctttctagtttatttagaggacaactaagaacaaaaacaatcatttacaaagcttgttcccacaccagttagaatggcgatcattaaaaagtcaggaaacaacaggtgctggcgaggatatggagaaataggaacacttttacactgttggggggactgtaaactagttcaaccattgtggaggtcagtgtggcgattcctcagggatctagaactagaaataccatttgacccagccatcccattactgggtatatatccagaggattataaaccatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagcacactatcgcaaggacaaaaaaccgaacactgcatgttctcactcataggtgggaattgaagaatgagaacacatggacacaggaaggggaacatcacacaccggggcctgttgtggggtggggggagggggagggatagcattgggagatatacctaatgttaaatgacgagttaatgggtgcagcacaccaacatggcacatgtatgcatatgtaactaacctgcacgttgtgcacatgtaccctaaaacttaaagtataataaaaaaaattttaaaaaaaaagcttgttccctagtgaatcataacaggaatcgtccattctacaaccctgacaatacattttccatagaattctgataatcatcttcaacaaaaagatattgtacatggccagtgccacaaatcaagttatttcacatcccaggttattactgagtgcccagaaagtctttacattatttatattttctgtaaaataatatttagttcccagtaggaggtaactttgcattaaatgatgtaacagcactttggaatatatatcctattagtgtgtatcatattagtacattatccctaatacaaaaatttcatctgttagtttaatggaaagctttactttctcctcacttataacttacagaaagacatattgaacaagttagttatgtcaatacatgtctgttaagctgaattccaaaaggaccggaagaatttcttaaaatgctctgcttacactgctgctgcattaatatcgctgaccctattaaaaacatacatggacagttctgtatttgtaacattttgtatgatttaaatgacaaggtaccataaaagggagccaaaataggtgttttgatgtttcaaaagtgattctctggggcagagtgagagtgattgtccagttaatttgaaagtgattgccctttaaacctgagttgggagaccatcatcatccagaatagagtgaattttgttgtgtagttgttcttcaaaccttgaggtgccaaggaatcttgctggtgtgaagactggttcataaaagcagaaatcgccctgagatgtggtgaacttgaccttgtgacttgacctttcagtcaaacagcccaccatacaacaaacagctgtcccaataacacagcgctttggctctccctttactactcaatgaaatgtcatagagagaacttcttacctagttccaaggtttgttcctcggttcctgctccatccctgcctttacccagcttcaaacatctggtctccactttctgtcttctgcttccggtcctgcacctgcactttgggagatgtggacacttagatttttggcaccttgtcttagatatggtttgaactcactctggtacccatgaatctggctacccctccactcaaactctggtctccaggagttctctgcctgactagtgtatccatcagactcaaccctgcccagacagagcagaacaaacagtctgccctctgtcctgtgaaggtactttatcagtcaatcaggagaggcttggggatgcttctgtgaccaacagctccaaagtcttctgcagtctaaagcaaaggtttacatttgacttattctatgggcccaccatgagccagctgtgactctgctccaaatcaccctcacttagaggctcctcttcttggaacttcactggtcacattaacatgaggaagaaagtatattgtactgcaaaccagttcttaaagacttgcccggaagcaaattgcattgcaaaccagttcttaaagacttgcccagaagtgatacatttccagtcacaattaattggccaatgcatcacataggcatgcttcatgtcaggacgcacagaagatcccactcaaagacaggagaaccaaagatattgctgaataatattaacttctactgttaccagaaaggggtcctgatctagaccccaagagagggttcttggatcttgtgcaagaaaggatttggggtgaatccatagagtaaagtgaaagcaagtttattagagaaataaagaaacaacagaatgcttacttcttaggcagagcagccctgagggttgctggttagctatttttatggttatttcttgattgtatgctaaacaaggggtggattattcatgagttttccaggaaaggggtggggaattcctggaactaagagttcctcccctttttagactacataaggtaacttccaagcattgctatggcatttgtgaactgtcatggtgctggtaggagtgtcttgtagcatgttaatgcaatataattaacatataatgagcagtgaggatgaccagaggccactttcattgccatcttggttttggtgggttttggctggcttctttactgtatcctgttttatcagcagggtctttgtgacctgtatctagtgataccagtcctgccaacctcctatctcgtcctgtgactaagaatgcctaaggtcctgagaatgcagcccagtgggtctcagccttattttacccagcccctattcaagatggagccactctggtttgaacgcctctgacaccaccacaggcaccaatttttaagccaaaattttccaaccttttgttcatggaactgaaatagaccacagtattggctgcttagatctgttagctctcatgaaaacccaaagaaagctttaacttaatgtttaattaggacataagagggattgactgagaagaaataaattcttcctagaaaaacttctcctggaacaacaacagtcatttgtagcaatatattaataatgacagctaacgttacatttatcaggcatttgctatgcaccaagtatacttttaagcactttatatatattaactcatttaatcatccagcaatcccatgatgtaagtactcttttgattcttgttttataaacaaggaaactaagtcacagtgatgtttagtaatgtgctcagggtcaacagctctcatggtttactggttgctaatttaacccttaaattatcagcataaatgtataatgtggttggttcttctgataactccactctacactgggtcattgtgaacatcttggcttgttatttttaaagcaatgtctttctccaggcttcagtagacaacatttctggcacatttcaagaaggaatggactgggtaaaaatgtgcagtacttccacttctggctagaatgtagaaagtcacaagacagcatcattctcaccctaaccaccaaaacaagcctgatgagctacaaaatctaagttttataaaattcaccagagagtggaggaggcaaagaaacataaatcaacatggttccggaaaacagtgagcctctcataggtgagaagacggccctaattgttctcaatctgagcaaaatgatgggtggagaagaaatccaccatggaagagaacaaggagaaactaggcaaaattttaacaaaagtttaatggtcacatgtgatctggtgtgacagatgagaatgctaaggagctcagccacagggtctgcactgacccatcaaatcattcccataggctgtcaccaaatgctcagggtattgtgccaaaggctgtgttttggactgtttttgcattgctataaagaaatacctgagactgaataatttataagaaaaaggggttaattggctcatggttctgcaggctatataggaaacataatggtatctgcttctgaggtggcctcaggaagtttataatcatggcaaaaggcaaagggggagcaggcacatcacatggccagagcagaagcaagagagtgatgagagagatgccacacacttgtaaacgaccagatctcacaagaagtcactcactattgtgaggacagtaccaagaagatggtgataaaccattcatgagcaatccgcccccatgatccaatcacctcccaccaggccccatctccaacattggagattacagttcaacatgtgatttgggtggggacaacatccaaactatatcaagctgggataggtagaaaaaagatacacccgtgagataaatgaggactttcctaagtgcaaggcagccatgtccaaaaacagaactgaaaactccagaaagcacatctgaggcactctaggctctgaggtactgaaggcataggtaagttgagagaaatctatctgtgatactcccacaagtcaacaacagaaagacaacccaataaaaatgggcaaaagagttactcaaacagatacatcacaaaacaagattgtatgaaagacaaataagtacacaaaatagtggccaatatctttagttaccagataaatgcaaattaaaccaaaatgtaaaagaccgacaacatcaaatattggtgagaataggaagcaactagaactcttgtgcatttctatttacagtgtaggctgggcacagtggctaatgcctataatcctagcactttgggaggctgagacaggaggaacacttgagcctaggagttcgaggctgcagttccagggcaacacagcaagatccttctctaaaaaaataattttaaaaacccactaattaaaaatgttaaaattctaagtcagagtatgaaatagtacaaccaatttgaagaactgtttggcagtttctaatagttaaacaaacatcttccctaagacccagcaattccactcctagacaactactgtagctgaatgaaaatgcatgttcatgaaaagacttatttactaatgatcgaaactgtcttatgcataatagctcaaaactggagattacctatatgctcacctatgtgtaagtggataaaactttgttcatacaattgaatactattcagcaataaaaaatataaattactcatacacccccaaagatggacgtttctcagaaacatgctgagtgaaagaagtcaaacagaagagtatatatgtatgaatccatttatatgaagttctagaactgccaaaataatatatgatgatagaaattaaaacagtaattgaagtgacccaaaaggggccaagagacacttctggtgtggtagaaatgttatctggtttcggatggttagtacatacagttttcaaaacttaactgaaacaaagttttgtgcaatttattgaagtataattatacctcggtttttaactgtacatggtcaaatatcgctatttcagaatattgagaatgagtcagctccaaattcagtccatgatacaagagttaaaagccaggtcctgcaagccacccaaggtcaatatttttaaaatcatactacttttcttattcatagcatttaatggacagctacagacaagacagggcttgctataaaaagggcacaatcccatacttaatgagtgatcttttccttttagctgtctctagccagtgttatctcatgttgattcacccaaaacctgctgatgtgtcactgctataatctttcagtgtcagcctataattgtttagggtcagcctttaattcattggggattcctactctaaccacgcagagcttatcgactgtatggctggtgagagctctaccattaactgctggactgtttcattattgccacttctgatctcaagttctctatataagtctatgcaaacactttcctgtgagggtcctttgacatactccaaactgactacaggtgactgtaagtgagaacaagaacatctcctagtcttaacactgcctaaaatagcacttctcacactttaatgcgcatacaaatcaccaaggaatcttgttaaaattaaaatcctgattcaataggtccagagtggagcccaaggttctgcatttccaacaagctcacaggtaacggggcaatgctgttccatgggccacattttgagttgtgaggaccaagtattcttttctctatggttatgtcctctgtttctagaaatcgcctctctccatgtgtggatttgcaatccaggctttgatattcgacagctttaagctcaaacgtgcaagcgagggttccagcagtggacagaggatagcttttggatttcaaaataaacatttggacaggcattctagttttcatgtattcactcacaatgaattcatctcccccaatgcactcccatcatcaatctggaggattttcattgaccagcagctcctgcaggacaggtagcagatctttcagaatcatctaagaccagagcagtgggccacatgcaggagcctcaccaacacttcagctcctgcttcagcaggagcaccctgtctgatagccagggaaggaggaatgtaggtcagggagtccctctctgggatgggccagagtctgcttcaataatcaggtcggggggaagggcttcttttcccagtggttctgctggatgcaacgttgctcctcaggcaaacataaaggaaaacagattttgccccaaagtgacctttgggcaatagcattacaagagatggtaagattacagtgacagtattatatctgacatcccatagggacatattttgaaagtcttaaatctttaaataaatatttacgatgataaaaatgttatctctaagcaagagttccagactttattttttaaaaatgtacttgaatcattgaatctaagcaattctgaatattcataaatcccccaaccattttcttaaggatttaatctattatttagaacgaaactttatatttaaaacaggaaatatcagtgcttaatgtggtgtgatacacacgagttatttcagttgatcaggtttactgttaattgggtcagtggcattaatcctcaggcatgcaaatactttgccaaagaaacacaaacaactaaaactcataggcacataaatgacagcaaaagaagaactcttcaaattgttcacagttttgctagtttaacaagatgaactagtcatggtatgatgaagattaggagttgcaaactttgcatagcctgcttaaaatgtaaaaataaattctaagtgaaggcagccaggtaagtgcttccattaaggtacagggatctgtccattcacagagatctggagatttattaggaaatagggacttcaaggtgctcagctgggatacctagtactcagcaagacagttacataaacatgaaccaatagtcaagtatttattttattttcactgcttgtcatcccttctagaagtcttcctttgccatcctagggcattttatgacagtggttcaaggcattactcaacatttaactgggactagtccaatatgttggtggtgatcataaaatgcatactctcaggcaaggcaaattttcctaacatgggtttagctaaagaatcagaacttttctccacactcaaaatgagcagtaataaaagctgaaggtcatcagacatttgaggataagcagagataaattattatagaaaagcactgggttcttttgcaatatagtatcattaccatcatcactgtcatcatcaccattattgctaccatcatatacaattgatagtacaataaatgggagaagttgaattaaaaataattttggtaataactattaaatctttacaattcatataccatttgagtcagcaatttctctccaaaatatctatcctgaagaaatacacatgcaaaaaaagcatgcaaaagcttaatattataaaatgtcaatccttgccaataaaagtccagtgaaagtccaaatatgatttattttgggcaaattggcaaacggactctaaagtttacatagaaatattgtttaaaacaaggaaaaactgcaaactccctaagtaatttcgaagacaaattcatttaacaaatgtttatcaagtgcctattatgtaccaagtattgctttagccaaagggataattaaataaaactttggtatgcacctatgatagagcactaggctgaatataataagaaaatatttatatagaaaaaaagaaaataatttatatagaaaagaaaataatataaaagtacacttaacagatgtgaaaaaatgtgcaagacatgctgtgaagttaaaaaatcagtacaatatatgcaaaaatgctatttttaaaaaatttatcttgatctgagcatataaatatataaatgcacagaaaataactagtaaaacatgttattaacaggagatggatgattacttctggagagaaaagtggaattgagttgagtcatggaaagctttggttttgtataatacttggatttttaccagaagaatgtacttatcatatgtgcacctgaaatacatcgggctacctgaaaagcactgataaaacattccttgggacaatctggcctagaataaactgcacttaatataatgttttcaaaaactttcatatcattgctagtcatttttctaggagtttaaattctgtagactgattgtagacaaagtttatttatttatttaattatctagtggtggagggggtcactgaaaagtaactataattttttaaagacttattttagagtagttctaggttcacagcaaaattaagaggaagacacagagattatccatatacccctgcaaaatgtatttttattggaagaaaaggcaggagggcagataggttagagagagaacaaactcggatgatgtttaccatcagtcaaacttggattctaatctttattctggtgcctggtaaacatgtgtaccctcagaatgtacgcttttagtagaaaataataggacacctaataaaatatggcttaaacaacagagatttgttaactcacacaaccaaaaatccagaaacagaacagtgccaggcagggcaatctcaaccgctctcccttgactttttcttcatggttgcaaggtggctgctgtggttccaaacaaatactgcatcctcacaagacagcagtccaatgtaaaaaggaatgaggatttttatttatgcaagtctttacttaatcagagagaacacatttttccaacagcatccacaaatttccccttacatttagttggccagaaccaggtcacatggccacattcaaatcaatcactggaaaagaggaggaataccatgtttgacttaaacccaatcatattccataccctggggctgggccctctttcctgaacacagaactacgtgatacctgcagtaaatctggattcctctgttaacaaaagaagaaaaaaaaaaagaaatcatcattgaacacccaaacaaccacatttgctacaataagtaattaaatattcagtttgttcatctgtaaattgggccaaatgacctattctcataattgcttgaaacactgagattgcatatgtaaagcacttgacttatactagctgtctgatgaatgccagttttctctctccaccttcttcctcaataattctaacactatttcaataaggaacaattattacaacaggaggaggaagagtgaaggagctcagaactgggattttctacacccaaacagacagattatcctggagcagtggttctcaaacttgattgtagaccccaacacctggtgaacctgttaaatcacagattcctgggccccatccccagtaggtctagggtggactctgagaatctgcatttctaacaagatcccaggtgatgttgatgatgttgttcaggacaactcttcacaagccactgccctgtagcgaggcatgagccatgagccatgagccatgagcatgaatgttggcgtcagttgttctctgaatccccatcagcgaactcagggccacgccagccaaggacactggggagcagagctgtgaaacgtatgacatttctgaatagtttcagattatttccaggctgcaaaacttcagactgaaagactttatttggggataggccccttcaggtaagtttgaaagaagaggaaggccacctaccaacacaagccagctacatagtcgctcacctgccaacttcccaacaaagggagaacaaaataacaaacactcaaattctaaatgcctttaagggtttacaagtatttcaagcaaattatccttccttcttttatgcctgaaaaaaacatttaagcagagaccccaagaatttagggctcttttgcttctttgccaaaggacagttctccttgattgggctccgcacaaaatccaagactggagccccagacaaactggctagacgagcctgctctcaattgctttgccaacaatggaccaaagaactggattagcgaaaaaattctttctgtaatttgatgcaacagatttttcaaaacaatattttaatttgcataccaagccaaattccctctcagaggagagatagaatgcattccattgtgtaagacaatactcattcattcccacgcaatgatgtcagtgctcagcaagcaatgctctctctgcaattctatttcttgcctttaagtttctattataaaatttttaccacttcagaatcatgcatgatattgcaaatctttctgttatcgtttttacaaaaccaaaagagacaaggctgtcaccaactgcctcacgcacaattatttaatcactttttcctcttggtatgaataggatttctgaaatccatcttcacctcccaggactttcttctgatacgaatactgatttggatagtttacttttgccagcttttaatgttcagggagcagtctcactgtttgctgaaatgataggaggcatttcagggttgtaaggctgaaccctggcaggaattttgaggttaatgggaaacacactgggcattttcttaggggaaatactctggcacagggaagattaaagacaaaatgcattctaacacataaatgatataaaatggcgtgaagtagcatagcatggcagggagattttggcaagagcttgttcatatgattacatgaaagataccaagttaaaaaaaacacaatattctctctctctctctcccccgccccccaacaaacctgcctgcctgcctatttttttcgagttttattttagactcagagaatacatgtgcaggtttgttacctgggtatactgtgtgatgctgaggctcagggtacaaatgattctgtcaccccaggtactaagcatagtacctgatatggtttggttctgtgtccccacccaaatctcaccttgaattgtagtccccataatctccatgtgtcaaaagcaggaccaggtagaggtaattgaatcatgggggtggtttccccatgctgttctcatgataatgagtgagtctcacatctgatggttttataggtgcctggcatttcccctgcttgcacttattctctctcctgccaccctgtgaagaggtaccttccaccatgattgtaagtttcttaaggcctccccagccatccggaactgtgagtcaattaaactctttcctttgtaaattacccagtcttgggtatttcttcacagcagtgtgagaaaggactaatacagtatacagtagttagtttttcaaccctttccctattccctccctcccctctctagtaattcccagtttgtattgctgccatctttatgtccatgaataccccatgtttagctcccacttataagtgaaaacacatgctatttagttttctgctcctgcattaatttgcttaggataaactggatacctattacatatcccaaaattttaatattaaagaaaaaaattgaatttctatttgaactccaactgtgtgctacttcttttaattgtgaaaagcttgaaaaatatggaacagtgaagaaaagaaaataatacagtatcaaccagccaaaattagcaactactcacatctattcaatataacttagctatttttaaaataaaaaagagcagtttaatttttaaaaacccttgatttttttttgtgccccatttgccttttcattatttaacttgttgggtactcttccagtacacaggtttttaattttatttcatatacatcttaatcccataatatatcccaaaacaatacataatatagtcttgtatgttttctagtatctacataaatgctattgcaaatagtatttatgatactgaaactttatttttttcattcagtgttatacttttgagtccatcttttttgatacatataaatctaggttatttttaatgatagcataacattccattctatgactacactacagtttatcttttagtcagctaatgaaaccttcagctgttttccatttttcaccattacaaacagtactacaatgaacagtattgtccgtgtttcctaggcactaggggaagaggttttcttgggactatattaaggacagaactgcttgatcggaacatctgcatattttcagctgtgctagatattatcaaaatgttctccagagaggtgatagcaattggtattccaattggcagcactgacagtttctgttttccctaattcttgtcaaaaccctaactatatctttcttaaagtattccattcacccaagggtccctggtaaacaaccaaggtgagttttctacccacacctgggatgacactgcaagcaaatgtctcttcctctgctccccacccccagcatagaaacagagtgtctcttttgtgtagaaaactgctttcccacacagtagggttattagtcatgaagctatgaaggagtttctctctatgtacagtgattgatccaagggttggtatcagaacatggccaatcagactttctcttttggggttaatatgtgcaatgggagagaaaatatctgccttctttaaagaactgtaggagtgaggaccaagttgtttttgctcacctaaggatgaagccatggagaggaaaaaggaatcaagattatagaaattccaccccttggtatatgcccaattgaattgaaaacagaaactcaaacagttatttgtacaccaatgtccacttcagcattattcacagtagccaaaagatggaaacaacccaaatatctatctaccaatggatgaataaacaaaatgcggtatagacatataatgaaatattactccaccacaaaatgaaataaagtactgattcatgctacaacatggatgaaccttaaaaacattatgctaagtgaaataagccatactcaaaaggacaaatattgtataattccacttatatgaaatatctagaataggcaaatgcataatgacagaaagtacattagaggttgctggggcttggggaggggggagttgggaagttaatgcttaatgggtatgcagtttctgtttggtatgatggaaaagatttggaaacaaatagtcacgatggtttcataacattgctaatataattaatgccattggattatacacttaaaaatgattaaaatagcatttcatgttatatgtatatattttatcacaataaaacatttaaaaaggcacaagactactgaaaatttaaaaaggaaaaaagattagatggatagatagatatacagacaaacagaaagacacatatgtatatctccttaccacatcatttgactccctggatcataccatgcctgaagtctgcactaattcttttaactttcagttacataaaccaatacattttacttttaaatctattttgaattggctggcactagaaacttaaataattctggatcctgttatttcaggcataatagtgtacagttaggaaggaaaaggatatatcttgacatctgtttaggttctaaaaattttatataaacccctgatattagcagaaaatcaaccaaatcttattctagtctagtcatgtatgtgtgtgtgtgtgtgtgtgtgtgtgtgtgtgtgtgtgcgtgttagcagaagctggtaatagctcggataaacatgatttcataagttcatttagctgcttgttacgggtctagcccaaccatagtttttccagatacatttctcctctggttaatgggctaaaaagaattaagtgacaaactgaaggggataaaggagaagagagtccacaaggatgagaagatgaagagtaaaagtgattattttattctgctaccaaacagaaaatgaaatgatccaaaattctaaggcaaaaataattctcatattttaagcatttgtattgacctggagagtgggtgctcccttttcaaaagtcaccatctcttttagaagataccaggagtctcctccttttttataaaggcaactaatcattattctcctgatttcacctgtcctttatagtaaagaaattgacaaggcctcagtggaaaaaaaaagaagaaggggcaaggaaaggaaggaaggaaggaagagaacacctccttgatttttattttcctttagtttgacgtttctgtcttcacataagtatagcaacagacaacataaatatagatagaacaaaataattaaggattcacaaaactagataggtaatttttgctttgaatgaattattgaaaacaaaaacaattatactttgaatctaacagtttcttcttttcagaaattacacatacagcaactggtagactggcttgtaatcttggtcatgatatgacagaatgaagcaaaaaataaaataaataaatttgcaaagagataagctgtagccttaaaagtattatttattgtagaatttccttaaggacttaaatatgagtggtgcacaacaaagttgtaagagatcccaaaataattgagtgttataaaaatcgcagaaatgcaacagtcttcaggacaggcaagaaagagagaatggatttgtgtgtatgcagtagggagagagatgcaaactggcagatgctagtgactccaataggcaaaatctgatagtaaataataggtcacattttttttataagtgtttccacaatggccaggtttcagaaatgcaaattcaaaaggaaattgggtaaaatacaataaaaacgaattatttgttcaacatgaaaagaaaaatgcaaagagaagaaatactgcaacattatgaaagttgaaacattatttttcccctgaatttctttttttttggctctgaaatagttccataaggattgaaagaagggggaggaaaaaggaagcaggggatctcattgaaaaacaaacagggtttccaaaattcatttatgcttctcttcatccagtttagtcctttttccctctctttaaatgcttacatgggtgctttttctgcctggtattcataagcaagacattttgaaatatgtagcttcataccaataacagggtggggtgggacaccacacaaaggagcttgccttccaaatacaagcacaaggaactgcctcttgaaacctgtaacatttccaactctgggcaggcacagctggcttcatgtgtcagtgctaggtaagaccttccaaaaggaagcaacatgaatggactacaatgtatagtccatatctttttataacacaattgaaaatattagctgatttttccacgtctgacattgtgtgggttttcagtatgcttcaccttcatggtagttagttcagttgaatgaataatgccatagttagaggaaaaaattattcagcagaaaggagggacaagtaggggataggagggataaatgacatggaaagtcatttgatattcccagttaagcttcagaattggggttttgaggataattccaaacaaaatccagacattggtttggaaagtgtttctttaatctgtgttctacttctgtggcattgcaatgaatgttatcccaaaactgtaaatgctttcttcaaaccaaatttcctgtgaattggcaacaatcaaagtttaattggagacaatgcaattaatgttgagaaggatatatttgctctgaaacttctggaggaaaacctattctggtttggtaaaataaaatatgaaccacagtcataaatgattcatcctccaaggtagttctatgatacatttgagggctcctttaaatactgacattttcccttgtaatattaggctataataattaaatgtgtttcagggagttggattccttatctaacatttattttaattcaaagtcatggtcttaatttcctttgcacagctctgaattgaggtaggaggcgggacttgactttggagatggggctctcagaccccagacgaaattgaggactagctaaaacagggatggggtggaagcagctttccacatgacatgcccacagtgtgccacatcagcttaccattgccatggcaacacccagttgttaccacccccttccatggcaataacccaatgacctggaagttaccaccccttttctagaaatttctgcataatctgccccttattttgcatataattaaaagtgggtataaatatgactacagaactgcctccaagctgctactctgggcacactacctatgggatggccctgctctgcaagaagcagtacctctgctgcttcaataaaagttactgtctaacacgactggttaacccttgaattctttcctggacataggcaagaatcctcctaggctaagccccaatttgggggctcacctaccttgcatcatcacctcattttctcttcatttaagcagataggttactgcttctattcattggctcactatttagaagcagagagcgatgaaattgtttcatatgtacatcaatgactatcatttgttaaacaggcattctagctgctttgtatattacctaatttaatcctcaaggcagtgttttcattgtcatttcagaggaaaaaaacaagtttctgaggtattgaaaaacttgactgaggctagattcaaacccagaactggtaccaccacagttctcactgcacgcaattttcactgtgctatgctatctccaagtgaaagaagttggcaatgccatcataaagaggactatgtgaaactaccaactaaatgttcattgaggatgaacagaacaagctatatcagattaaagattttttctaaaattttaccaacaagagctttaaaaaacattctagaactgtaaccccccttaatcctaaatcactaatattagtttatctacatttaaactattggaggtttaatttttaatatcctaattaagtgcttattagcatttttagaaatatagtatttactacttaataaaattaataaaaattgaaagtataagcaaactttaagttttcaataaaatacttatattggacctgaagaatatttcctacaagaaatcgaacatggtcttgtcatcatccttatgcctgtttttctctttacttctgagaagatctggtaatttataacagaacaatattgagaaacagaggaggagaagcagttgtgtttaacctgagaataaatcagcacactcctgccaccactgtccagcagccctgctggtgtccaggagaggtgctgggaatatttcagatgcactgcctaatgtggtgaaattgtatctccaactcataaatgctgaattagctacctcatctctctttctggtatttcacagaggagaaaagtgaaaacaaggtgtccttagatcagacctgggaaaaaaagaggaggacttgttcaccaacttaagaatctgaaaaaaggtatatttctttttattgaatagggagttataaatatatctataaataaacatttttatgtgattgaaatattaactatcaccagactacaatgtggtatctttttagcagacagtaacacatatttgaaacaaggttctcaaatgccattgtgattttcacaattctaataatgaagttctgttctatcttgtatgtttccccaaatgatagccccaaaagataatttgtaacaacatatagagcttacagtatgcaaattaaagtggaataatattcaagcacctttcccatgtaagtccaaatccatccctccatattttcttgtgtatgattgaaatgatcttattagatcttaagaacataaaatgaggtaaagtgtgatcatcataggaagcatataatattaaggtatatgcatttttaaataatattctgattcctccaaaatcccacaattttgttaacagtctggtatacatttttctacatctctctctacatctttctcaggcccactgtaacatgtacctacattaaaaaaaaaaaaactttttacaaactttaaaaaaataggactctattactctacaatttgcttctatcatttaccaaaaaatctttgatatatttctgattaatacatgaaaggattaattatattttaatggttacctaatgcttcacagtatgaatatatagtaatttattaaaatgttcatacttttataggcactttggctatttctagtaataaacttctatgaacaataatttctagtaatttcttccataaacaatgctacagtaaacatcccttgctctatatatacatctatttgtaattttatttctggataaataagtctccaaattaggagtattgggtaaaagtgtatgtccattttaaaattaatagatactgccaaaaatcaatagcgatttatgcttggcttaatgtggatacaaatgttcacatatggaaatatttatagatatgtgcacatacatggcttactttgcaaacatatatttcctagctctgccagatgaaagagcctactagtaaaaagccaatttagcacccagatcttggtttttaatatcattctcaaataaaagaaaccagggagttttggagagatggctaagcctaaagctggtgcaggaaacacacaaaatgagcctggcgcatcttgtagtgctagaagtaaagaagtactaaaaaaacaaacaatcacaatcatgagagtatgccaaagggacacaggagccaagtgaaggagctccaaatggccacagctaggacaatttgagcaacaaaataaataaagcagcactggattataacccaagtacaaaataaatatccatgagtccaaactgttatgaataaataattgaatacaatccaagcagtattggattataacccaaagtataaaataaatatccatgagtccatattgatataaataaataattgaataaataaatacatgggagaacagacaaatcttacatgtagaagaattccaaataattctcatagatcttctgcccccggggggtagaagataatttcctacttcttaaatatgatctatgcatggtgacttccttccaaagaaagtagtatggaaagggccaaaaaaaaaaaaaaaagaataacttagcagtggagaaacctgacaaacactactcagccaggtgatcaagctcaatatccacattacaaagtcacattggtagtacgtgccactgatataacgtgatgagaagggtatgtcacttccgtggtctttcttccaataacccacagccccagctaattatgagaaacctccagatgaatcctaattgagggaaattctacaaaatacctgtcaaggtcatcaaaaacaagagaagtctgaaaaaccatcacagccaagaggaggccaaagagacatgataactaaatacaatggggcatcttggatgagatcttgggtcataaaaaggacattaggtaaagattaaataaatgtaataaacaatgggttttagttttaatgcttcaatactgatttgttactttcgaaaagaataccatgctaatgtcagatgttaatattaggggcaactgggtgcagagtatatggaaactctctctgtactatctttgtaacctttctgtaaatgtaaaagtattataaaataatagttttattattttaaataacagtagttttaaaaacagcaactaacgtggaaatttaaagaaaaatataatagcaacaaaatacttcaaaatacatttttaaaagcaggtacagagcctacatgaataaaaccattaaattatattaaaagaattaaaacaagattttctacaggaagaattcctttctgagaagacttaaggtcacaaaaaagccaatctactggtttaatactatttccataaaagtccaagcaaagttatttagaatgtgggacttttttttttttcttgatggagggttgggaggttgaatcagatcaaaactgattgtaaagtttcatgaaaattgcaagaaaattttaaaatgtaataatgaagatttgcttaataatgttttaaaacatataataaagttactataatgaaagtgtggcattaacatgacaacagataaagagatcagtataacagaatagaaaatccagaaaacagatccaaatatatatagtatgtgtatatacacacacttatgcacatgcacacacacacacacaaacacacacatatatatatgaatttaatgtctgttaaagcagtcataccaattcaaaaggaaaggaatagatgatgcatttggaagggagagaagaaaggaggtaaatagaacactacaagccaaactcaaaagccaaagtgcatacagcattttgaaaggattgaaggcatttgaacaagagcacagggagcagtttgggattagggaaagcagacaggagtatctttggagaaggctaaaatgccagcttgtgtttaggctttatccaatagtgaaaggaacactaaggaaagatttgattgagacagagagttgggaatgggaggagtagaagactcacatttattgagtactgactgtgtcttaggttccgggaaattgacataggaggtcatttactcctcattacaactgtgtgagcttggtagttttcaattagtaatttgctgttgttcttgttagcattcatcccactgttttattttttgtggtaatacttacattgttactttgaaatattttcttcatttttaaatatagagacaagaagtaatcatgctaatagttttatgtaaaaagattttccatataagagaacaaagttatgattataaaacaaaagaagcaaaaaaaaaagtactgttcacttgagttggaaatgttaatatgagctcacaagtttaaaaatatgtactttctggctctgtcaactaaaatgacctaggagcaacagcattctggtagaaataagtgcccaagtccctagattttggcctctaatttcattcccccactgaaaggtactagtgttccttggagagatggccaactcaaagtctgatatagtggaagagaagatacaagatgagcctgtgacaccatgtagtgccagaaatcaaggaagatttcaaagataaatagggttatttcagaaggaaactagaaccagcttaaagaggctcctactaatctatgatgaaaacatgagcatcaaaaagagtaactgtagttaagtgtcctcattttaaaagtaatagctatagaaattcaagctggggaaattcagttatttttccaaggaaatgcagtctttaagtacagtcaatgttgaatatgagtttctgtgactccaaatcaatgtttctaccatacaccacgcttctcgagcaatgtttaactgaagagaaaagtgcagaacggaagagaatacaaagaggtagctaggaaaaggcaggtcaagagcccaaatttatctttcactggaagaattttctagtaaatagtcccatccgacaagacaaaaggatgattacaaatatccaagcagcagctggataagatggccttttagagaaaccacgaaggtccctccttggaattaatatccagatgtcccaagtgctcctgcttcattgtggcacttccctttaatatcccaggagaagtggtcaaattcccatcccatgtcacaatatatttccctgcccaggtatctttgacatggagattcctaaagatagttgttgactattccttaagttcattcactctggtgcccttgaggctacagccagccttggaatttaccaccttaatatctcacaagctttcccagcaggctgcaataactgttctcacaactttgtcccctacagagacattgaccactcctttgatttcagaaagcaccgctaagaccaggctacagggtttaataagactttactgactacaggagcctaaaaggagagaactgtaatgcagaagagaaaacgtaaaaatggatatgaaatagcgtagctcccagtgcccactacgttgcagaattgagcccacctcccccacccccatctactcttcctggaaaggcttttgacggttgcctctcccatatccacactctcctgggacctagagagaggcaaccaaagtttatccttgattaccagcgtcaggtatgcttcctgtgagtgtacatctctgacctacaatgaagaattattatgcagatggcttagagctatgacttccctttggcataaccaaaagagttactgtggttgtctcttttcccctacaactaaagagcccccatcctcaatggagaatcaaagatccatttctagcaacaaaataaaccacagaaacttcaacactagggtgtctttttctcccaagactcaaatatcgcaggattaatttcttcaattaaggcccagggttaaaattccagggattcctttcatccagattcagaaatttcagtgaaaggaaagctgtggccaagcatgtgacctgagatgaaaagatcagccttgatactggggggaggtaaggtaaagataggaaccaaacatgatacccctcgcctttccagagcaaacaccaagggacaggttactcctccacctacccccacccattctatgattcaattagacccaagaactgcactttattttgtgtctcatcttgaaaactaggaagttgcactgatgtattgtgacctcagggtggtatagagtacagacatgcaagttggtctcagccatcatctgaaaacattctccacacctatccccagccatcacaggctgctgtccagtgtccagttgcttgctgcttgggaagggcaagcagtgggtctcgggtctctctctctctgtctctctctctctctctctctctctctctctctctctctctctctctctctctctctcgatccagtgggggaagagaagatttgcacactcctctcttgtaggtctggctctgtgcccctgggggctgacctaaatggactttgtgaatgagccttccaatggggagtctcaggatagtatcagagaaagtgaagagattcagtttgaagtaggaattcccccagtgttgtagctgcaaagtgatcttggtcaggttctgttagctgaaggtcacagcctagtcaggtagccctcttcactcagctctctttgtgtctgggtcctggaagctgatctcttccctccacccttctggcatgggatgccaacagtgtccactcactagcttacaggtagcgtacctacacttgaggttttcacacctttgtaactagaccctttactaaagtcttttcagattactcaacatgaatgtgccattggttatacaagcagtttaaaaacttctaactcatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaaaaaaaaaaaaaaaacttctaactcataccgttgtgagatggatttgtactctctaggacagctgccttcttgaggcaggtatgcaagctttcacggggtccctttgggccaccctgaccacaacacctgtaacgtgacatggccttttgtctcactcactgttcccagtcccctcttagcatctgtcccagcattgcacacaattgcctcctaatgctgaggtccccttgcctagggtgatggacattcggatatgtcatcttgatcccttttcaaggaaagccttgttgtgctgagagtgctgcaggcagacagctctcagctggcagcaacttggcagcagaaggctgccacggccaaggtcacatccttcccagggtggcctatacccaatggccactggtcaaagcaaaggtataaaattcctgtcatttggcccaagtgcgaccattatgatgggccattttactccagaactctccatggaaatggccaaagctgactctgggcctgcattgaagctcagcttccctctgcaaatcccgctttcttcccctccttttcccaggtgttgaccccaagggtcatgtgcacactaaactattggacatgtgcacactaaactccttctcatggtgtacttactagagaaaccaacttgtaacaccttgctataagattcctgttaaaacaaccctgggccaatattcccatcacgagctccacagctggtctctggaatccatgcactttggtgggaaggcagttcccttccaaatggagtcccctcccctctaccataggccactcagcgttcctcagatgagtcaggcaccagcgctctgggctctccagtttcaaggcacagacctcacatttcagtgtaggttgcacagatgctcccctcactaggactggggctagaggtaggagtctccttgccttcattcttgggagtaagaaatgggactctcagtgctacttcttccaaggaaatccctctaccaaacacctctttcctctgtccccttgacccttttatctgtcaggtcattgagtcttctattcaggttttccatggtctacttagaattattgtcctggtggtctcttggagtgtgatgttcattgtcttcattccccagccaaaactgaccctggacgagtccccccttttaacatgttacattatggaaatgtttgaatatggcaagaataccttttggaagaactctagcagaggtctctaagtaggaaaatgagtggctgggggagagggatgggattgagacatacttttccctcctttttgtcttctgggattttgtgccatgtacatgcatgttatacctgttaggttgaactttatggaaatacaatttttgataattttttggtcaaagttttcttataacttgtctatactcagcatagtcaagtgtaaggaaccacaggttccttactatttggtgtttctcctaccatcagattataatcatttcatgtggcctaagctgttacctctttctctcaaacctggaacctcactatataattttcctacttacatcttatacactctaagattgcctttagaagcagaatataaacaggatgtaatctaaggaagatagtcacattcccattctgtcccaccctacatccaaggtcccagtaaatcgccctccttcaaaactccgctgaaatgccaccttcaccctcaagtcatttctgtatttctttttacggcttccagctcactgaggaaagactgaccatttcattgtgcaggtacttatcagaaaggatctcgtatgcagtattgtcctcatgcataggcaaatctttttcctttattagactattcacttttaaggaaaatatacaagtctttatatcccaaatgagaacagtgccaggagcagaacaatagacaattgctgaatgaacaaatgacttcgttataaaagctggcattattttatagcataaataagttcagcaaaccttttatgatggacactccttattccggtatgagtaaaatattctctctaaatgtgcagtgggacacaactgtggaatcattagcttatgctgactcactcaatggtccatatatgatagatgtcttggatacacagtcctagcacacagaaacatactctttctgaaaacatgcctcaacaaggaagggtagccagtaagaccctggctcctacagacgacaattctgttacgcttcatagcctccaaatttctatcttgcttctaagtgatgaggaatttcaagtctccaaggagaaaaaataacatgagaaaactttgtcaggaaactgcaggcccctggggccagagtttagaaaacacttacgcaggtgagactgttttcaagaagtttcgactatacaaattcctctttgtcagagtaaccacatattagtccaagacagttattatattttcttattataagcatgcactgttttctgcatctggtgcatttgccaaattgtagatttattcctatttctatgcatctgtgaaaagaatgtgtgttccatctcatcagggagttacttgaagtcacaggttgctaattccaaatgaatagaaacaatgattaatctgggagatatgggctcaccactatttatgtaacagatgtccattatgatgagttacacatttgttccatgtttacactagaatacaaaaaaagaggattcaactattttgtaaaaaagaaagaaagaaaaagaaagaaaaagagaaaaagaaagaaagaaaaaataaagaaaaagggggatgtgggaaggtagggaattaaaaaagtacttgaaaatgtttattcaggtgccaggttagatgccacagagacatacagtatgtctggagggtggcaggtaaaaagctgaggggaggtagagagctaggggagagagggaagtggggctcaatgttcctggcttcatttcagggtgtggagattaactcagtcaatctcacttggctgacagaagcattaatgccaaaaccggcaatttcatcagcatcagttacacagaagatgggatttcagaggaaagcacgagaaaagggagaatgatgtatgtgattttattcaaataattaaaaacaaagttggcagtctatcttcctgtcaagaagaataaatatcagactatggagttggaagaagtgcaagcagcttcctctgctccatattaactttggtccaatacaaactttagagctgactcttcacacaaacaaaaatccttttccaatgattctcccatgtgttttttcagttactctgtgcagcaagaggacatgagccagaggtaagtgtggaggagggtaccggactgagccacactcacgctgttagagtgagggccacaaatactacttctctatagctgagcaaaagaaaggactctagaaatttcctttctctccttattttcatcctgtcctcataagcgcaggccctgaatcaaagcagggcctggcccatagtaggaactgcatagataagtagatagatagatagatagatagatagatagatagatagatagatagatacatagataataaatatataatgcatgcatttaaacatggattaaattaacatgggttggacttaactaatgacatatgcacatggatggataatatttattaatggattcattatcttatatactatatttgcagcctaactgaattatagcagaagcagcatcgtaactgaaagttcaagaatcccttctgaatgtcataacatggctgctatgtgttctaaattatacctttccagagagtttcttttttattaattttattaataaaaaataaaaatttgactagattcactaaagggtattgctcataaaacattttaataaacatttctctgtatttccagtaaactcttaaattgctttttaactacttccaaaacattgaatttaagatgcaaaatgcttcacttttacatcgaaacctttctttttattatttaatgattacaagagaaatgaataatcctctctgcatttgtaacatgcccaagtccaattagagagcagaactattcttcagaaaagtcctaaattgattggactgctgggagccatacaaggcaacaacaatatacatatcaaccttaggcaatgcaggaagggaaacactgcaaaggtaatcagatgattatggaggaactcagctacttaaaaatggcacattgttgtccagattggaagtgtgagtgctctgagcctgttaaaaggttctttcaggcatccaaaacctctttgccaaaaaattaataatcttatttagtctaatcccaccaagttagccaagttgatgaagacagaaaaagactcaatttttgaaggaggtgggaattcggataatacaagtgtcagcagaggttttctgtgaagggccatatagaaaatattttttttggctttgtgtaccatttggtctctgtcacaatcactcaactttgccattgtagtgaatgcatccatggacaacatgcaaattaatgggcaaagttgtgtcccaataaaattttgtttataaaagcaagtgggcaagctggatttgcttcacaggacatagtttgctgactcctagaatattatgtagatggctctccaaaacagactgaagcctaagaaaagacgcagatctcaaggtcaagttgaaaattatagtgtttttaagttccttgtattttaaaatgtgcttagcagtacctttacttcttgtatagatcttatggtgtttgccttccaatagaattttccttaaattcatcttttagatgtgcatgtcttttatcaaattgtctgcataagcttgaattcagtaaaaaaaaaaaaaaaaaaaaaaagaaaagaaaatcattttaagcattccaggaataaagaaattactacaagtattagtcacatggatattggaatacctggggtattagggtcaagaaagttttgaccaaccatcagagcatcagacactgaatattttagcctgacacaccaaagtgggtggttagcaaaaacttgacagaaaactgctcccacttgcaagaatatctgagaaacctttgactaactgtttcagtttgcaccagcagagtatcttgttctcatgtactccctgcaaagccaatctaagtctcctgcctgcctaccatgtagctgcaaccaccccaagcataatagcttttgtttatctttcaaccctccaaaaaatagattatgttactctctctggcaaactaactcaagaatgcacagggaaagggacagaaaatatatagcactctacttctctcctgcaatgcagaagagctcttagaagaaaatggtagtgatatctacttggcaatggacaatccaccacagtttgcccctttgtcaatgcagcagccatacacacccttcttacccatttttaacttccatataaagtaaaccacataatgtttctgtcctacttgatgcaactattcttcatacatccaaaacccactcacactttcccccaaagtgaagccacaaagtcctatttgttattttatccataactggttgatctttatttgccttctaggtcggtcacaatagctgtttatcctgcaatttaaatattgaaatatgggcttaactcaccccttatattctgtgacagacagaggaatacaggacaaatatcattaatatgtacagatatattcatatcaaataaggaagaaaatatacctattacaatctgcatttctacatctgatcacatggcccttgttagtatctacaattttatttttctactactcatggggatcttagacacccagaagagtcaaatgaggtcattgtccatcctgaaggccaagttgggatttgcaattctccagtcatcaccaggtgatgtgtgatagtccagttcaggtctccctaactgccggggtacctaagagagcccaacgcctcacctgctcaagtcacccacttctgggcagtttcctggctcaaaggaggcaaacagcctacagtcggaagttccaaggaggggaagagatccacccatgcttctgtattctcatatacactcctcccacctgtgactctcattttttaacctttaaatctggtccctggtccacttgagtggtataaagtctaactctgtctctcccactcactgtgaaatccaatagattttacagagaatatcttcattcaaattacacctaaaaggcatgtattaactctctttgatctaagctggatagtggagttgattacaggctggggttcatggatttagattctgcatgaacacattttgctttgtaccaagaaaaagcctatttcaggacttcaaagtctaactcctcctggccagccagttctcaatgtgtgctggtggtcaagggcaaggatagtttgtgtgatgtttcagtgcaatccctccctcattcctaagaaaccaaaacagaaaaattttcccttaatgatagacttactgggcaagagataatgagattcttctttatttaaaaaaatggtcaaaatgttagtatcatctgaataagcttagtcaataaaactccccaaatacccaggctagaatgcccatttcgaaattatctccctatcccacatgcaggtgtacacacacacacacacacacacacacacacacacttttttcttaacctcaatgcaataaagatctggggatattgagtatcaagatctttggaatgtcagagtaaggcaccagaattcttgtttgcatgaggactttctagaggtcagtgttcctctaactctcttaatgataagaagcatcaatgacacttgttaaaaatacagcttctcaagtgcctctcctggaaattctaactcagtggaagggagctatgctccgtccctgggaaagctttagaaaaaatacagatttctaggtccccaacccaaacacactgaacctgaatttctaggaatgggcccaggaaactgtggttgtaaaaagttccttgggatattaaacaaaaattagtcagctttggggtttgctaggagaaatagtcaagattttaggactgattgtcagattctaagactaaggttttttgttgttgttgttgttgttttgttgttttgtttttgttttgttttgttttgcttgagacagggttttgctcttgtcgcccaggctagagtgcagtggcgagatcttggctcgcgacaacctctgcctcccaagttcaagcaattctcctgcctcagcctcccgagtagctgggactataggcacgcaccactacacctgtctaattttttgtattttttagtagagacggggtttcaccatgttttggacaggctagtcttgaactcctgacctcaggtgatccgcccgcctcagcctcccaaagtgctgggattacaggcgtgagccacagcacccgacccagattctaagaataagattcttaagcaaagagtcttaaagccagagtcaatctcaagggaaggttgatgtgtgtttctgagcaaacaggaaattaccatgaagtagaaagacggagaaaatgcattggcccaccaaggttcactctccttgctttttttatttaaaaaaaaaaaaaaatctcctctgcctttctccaatctggctgcagtcctatttgaacatttgagcagttaaataaggctttaaacacttccctctaatcaatcagcaaattatttccttctcctcaagatgtcactttcaattttaaaaaagacatatgccgtttttctcttgacattttaagtttttcaaatttcagaaaatgttcaataatagcaaaataaacaaccatatacctaaattcaccaattgctcatattttgccacatttgctttgttctctctctctctatttgagtgtaagatgaagctgatctcacagtacttcatccctaaattcttcagcatacactcttatgaacaagatattatcttattatcctactaaaccacaacactgataccacactgagaaatttaatattgataaaataacattacttaatgttattttaagtattttatgttatttaaatgttaaacatttaaatgttacttaaaataacattatttaatatacaatccatatttattcttcatattcaccgaatcatgtacttcatgactgctttcaaaaaatcatccaagatccaataaaggattacctattgcatttagtacaccaggagagggaatcttggaggtcatcttagtattccgcctatcacaaattagcttattactccttggtaatactctgctatgaagtctactgtgtttgatattaagatagccactccagctttcttttgattagtcttgtttctttccatccacttttacctatttccatctttatatttaaagttagataattgtaggcagcatgtagttgaatcttgcttttctatccaatctgataatctctgcatttaaattggaacgtttaggccatttatattgaaagtgattattaatatgattagacttaagcatatcatcttgctctctgttttctatttgtctcatctgttctttgttctctttttcctcttcctttgccaacttttcaattaattatttactgtggttctattttatctcctctgttaacatactcattaaaatcctttgttttgttattttggtcactgatttaggtttcatagtgtacatctttaacttatcacagtctaacttcaagtgtttttattttttttttagaaacttttattttaggttcggggtacatgtaaaggtttcttacataggtaaactcatgtcatggggtttattgtacttattatttcatcacccaggtattaagcccagtacccaatagttatcttttctgctcctctccctcctcccaccctccaccctcaagtaggcctcagtatctgatgtttccttctttgtgctcataagttttcaccatttagctaccacttataagtgagaatatatggaatttggttttctgttcctgcattagtttgctaaggatagtagcctccagctccatgcatgttcctgcaaaagacataatctcattttttatggctgcatagtattccatggtgtatatgtaccacattttctttttccaatctgtcattgattggcatttatgttgatttcatgtcttcactattgcgaatattgctgcaatgaacattaacgtgcatgtgtcttcatggtagaatgatttatattacactgagtatatacccagtaatgggattgctatgttgaatggtagttctgcttttagctccttgagaaatcaccatgctgctttccacaatggttgaactaatttacactcccaccaacagtttataaatgttccctgttctctgcaacctcaccagcctctgttattttttgactttttaataatagccattctgactggtgtaagatggtatctcattgtggtttttattgcatttctctaatgatcagtaacactgagctttttttcatatgcatgttggctgcatggatgtcttctttagaaaagtatcacagaaagaataaaacacctaagaatacagctaaccagggaggtgaaaggtgtctacaatgagaactataaaacactactcaaagaaatcagagatgacacaagcaaatggaaaaacatcccatgctcatggataggaacaatcaatgtcattaaaatggccatactgcccaaagcagtttacagattcaatgctattcttgtcaagctgccaatgacattcttcacagaactagaaaaaactattttaaaattcatatggaaccgaaaaagagcccgaatatccaaggcaatcataagcaaaaagaacaaagctggaggcatcacgttacctgacttcaaactatactacagggtcacaataaccaaaacagcatgcatggtactggtaaaaaacaagcacacagaccaatggaacagaatagagaaaccagaaataaggccacacacctactaccatctgatctttgacaaagctgacaaaaacaagcaatggggaaaagactctattcaataaatggtgctggagtaactgactagccatatgcagaagattgaagctggactccttccttataccacatacaaaaatcaactcaagatggattaaagacttaaatgtaaaacccaaaactttaaaacctctggaaaataacctaggcaataccatcctggacataagaacaggcaaagatttcatgacaaagacaccaaaagcaatcataacaaaagcaaaaattgacaagtgggatctaattaaacttaagagcttctgtacagcaaaataaactaacaacagagtaatgaaacaatctacagagtgggagaaaatatttgcaaactatgcatgtgaccaaggtctaatatccagcatctataaggaacttaaatttttaaaagaaaaacaaacaaccccattaaaaagtgggcaaaatggtgattattacaccatttcttatatagcagaagaagcttccaatagtatatttctatttctccccctcccaatctttgtgctgctgttaccatacatttacttctacctatgttataatacacatatgacaggattaattttttttaattatactttaaggtctgagatacatgtgcagaacgtgcaggtttgttacataggtatacatgtaccatggtggtttgctgcacccatcaactcatcatctacattaggtatttctcctaatgctatccctccccttgtcctaaatactaactgactggccccggtgtgtgacgttcccctccctgtgcccacatgttctcattgttcaactcccacttatgaatgagaacatgtggtgtttggttttctgttcctgtgttaatttgctgagactgatggtttccagggttattatttttatttaagcattcaattatctcttaaagaaatttaatagtaagaaaaaaactcttgtatacttatcacatatagtgaccattttgaatgcattctttctctttgtgtagatataattccatttgttatcagtttccttgtgcctgatttttttttaacttttctcatagtgtggggctgctggtggtaaattctttcagactttgatgtctaaaagtctttcacctttatttttgaaaaatagcctcattgggtatagaattctaggttgacaggttttttttttgtttgtttgcttgtttgttttgtcccacccacccctggtatttcgaagatgcaaatccactgtcttcttgattgcattgtttccagtgagaaatctgctgtcatctttatctttgttcctctgtatgcaatgtatctttagtgtctttatttctctggatgcttttatgactttttcttcatcagaggtttagttaaatttgactatgatgtgtcttagtgtcattttcttcttttttatgctttaggtttattgacctacttagatatgtgagtttatagttttatatttttggctattgtattgaaattttttcctataatccctcttcccccttcagggaatccaattgcacatatatcttaggctgtgtgaagttatcacacagatcactgatgtgctgttcatttaaacaatttttctgtatgttttattttggatagcttttattgacatatcttcacattcactaaccttttcttctacaatgtctactctgtcactattcccatgtggtctactttgtctccaacattgcagttttggtctctagaagtttgaattgggtcttttctatatcttccatgtctctacctaactttttgatccatttgggtcttgctcttaagatttgttaggcggggccagagttgtgtttagaacgaattattcttccattattgaggcaagatccttcagagtttaccatctaatgcttcatgaattatgaggttttctaagtcttgctggtggaataggcactattcccatgccagtgagagtgctgcatatcactgcctgtaatcctttcaggtcattatttctctggttctgggtagcatcctcacatgaatacactgtcagtactgtgatggatattctgcaggtatccagagtcctatctctgggcagctctctcctccctggtactcttttctgtgaattctagccttgttgttctccctggactctcagctccacctcctcatatcatggagttcatcaagctccaccgacccccttccccagcatgatggtctggaaattctcccaaggcagtaagcttgggaaatcatagagttcacttcatttatcatctctcaaggaccactgtccttcattagctgatattagtgtcttgaaaatcactacttcatatattttgtgtagttttttttgtgttatttcaggtaagagggtaaatctggaccttgttattctatactagtctgaagtacaagtccatcatttttagttttgttctgtttgttttgttttaaacaataaataaattaggtcaatctcttggggaccttcactatacaacattcttttaacctactttattatactccctattttagaaaaccatgccaacaaacacatttcaaatgttgattagtcagaagtttcacaaagttaggtggttctttccttaattaatcagaagagtaaacttttcttgtaataactcacacaaaatccatgctgatttataaacaatatcatcataaagctaatatcaaatacaaataaatcatagatagcctaagtattgaaacattttagacatttatcaaagagttggaatactataaatcagctcaatattcagaatccccagagtcaacattctagctcccacatgatttttttggtgtctgtttatttagaacacaggctgagttcactatgaacagcttcaaactgaaaaggtgagagttaagtacatttcagtgtttgtagttttttccttctcagctttcttccatcaaggctcttcagatcattgctgtcaaagtctgtctccctccttcattttttagccctgttatagtctatcttcggcataactatatcctgttatagtctatcttcggcataacttctaactctgagtcctttacccaccattagttggggtctggtttgcttgcaaagaatgcatcattccaccattgtaagcatgtatgtacatgtaaacaaaacagaacaaaatccttgataggacaaatctcactgcaactgataccatcataataaaaattttcatataatacaggtttttcaatctcaaatattgattccatttattttaagtaatgttgaatacacacacacacacaaagaattttataggacagataaaaatggctttcaactggtataagacagtggattaaagtatcagaaggacctgggttccacttttgctctacccttactgtgattcccttatcatgttatttaatatctctaagcatcaatttcctcattggtaaaatgtacacaattataattttatcaagaaaaattatctaaaagttgaataaggttaaaagggtgcggcatgacctttcaaaattttaccagagcactgactggtgctaaaagttacttcattatctagggaatgtacctgtgtttgactttctattttctatttggttagaatttagatgactgaagttacgttaattcataaatttctatccaatagaaaagataacatcaaatactgtggttttattgctttgaaggatattaaccagttttaaatgtagcctcaaaatcttattcaacacttttttttccctcaaaatgtctataaataccagattcctcaaaatgctcttggaattagtttaattttgtaatggttccaatcattaatgagttaaatgactgtttggaatgttttcattccgtatgtatatgacattcatgtttttaacttgttaaaaattatactttaaccgtacctatatcatcaggttgttacgataattaaataaaaattaatataaagtaattaataaggccctaacacattttaatcaatgaatgttagctattgttattatctattattaaatgaagtttggttcacaagaaataaaaaatatattatatgccaaacttcacctatagatacccatgaggttaaaacaaaataaataaaacaaagagaatattgatttcctttgggacttttgagtcttccagtgtctagcccaaggaatcaagcttttgaatcagtagccattttcatggatgatgctgggacttatatttattgggatacataatcataaacagaataaatattgtctcataaagaaaaagaaatataattttcccacttcacatgactgataatagataaaatagctaaaaattgattaaagtaaaaattaatatttttcctttaaatcctgccttgatacacccaactgctatctttcattttatttcctttaattttaatgagttatcccgatttttttccaaaagtttttttgtttgtttttttccattgttgttgttttttttttttttttggagacagagtcctgctcagtcacccaggctagagtgcagtggcgtgatctcggctcactgaaacctccacctcccaggctcaagccattctcctgcctcaacctcccgagtagctgggattacaggaggccgccaccacacccaactaatttttgtatttttagtagagacggtttcaccatgttggccaggctggtcttgaactcctcacctcaggtgatctgcccgtctcagcctcccaaaacgctgggattataggtgtgagcctccgtgcctggcctttccaaaagttttgaatagctatatccttcactccttcgtgtgatttcaacaactgctaaatacagtggtgacttccctccaaaaaaattgtcccctaaaagaaagtaaaaaataagagggctgcatgatcaatttctccaatttcattatgattttggttcctgtttatgctcgaataactttctcagattataaatcctcaaaaagaactcagtcaattttaggttttgggggtttctttattttttagatactggcccaggagttaaatcagctttggctcagaggaaccaattgaattgaatcaactgaataattgaataaacattgaaacagcactccagaagcaattcctatccatactgatgtctaaagaacaatgaaaaagcatctatagaaagaaatacaagtactggagctaaaaatttccacatacaaatgaaactgggatttactctgcactgtacacaaaaccagagcctgggtcatcaaatactttttaaataccttcaaatattgaaacacaatgcaggaacctacttaattcattttaaaaagcaaataaatgaatatagagacttacatcaaggttaaacattcagctgttgttcagttccagtgaaccaaagaagtgtacactgaatttaaaataaaatgaagacacataatatatgaggtactgaagtgctctttacatttgcagagctagcttatgcttccagacaagttcagacatacatgtacatggatacacacatacttgtgtatatgcgcatgcatttatacatatgtgtaatatatgtatatatattcacacacacacacatttcctaaccaaaaaggaaaggcttattgttttcatgttgagcctttgaaataagacattagcactgagcaagtggagaaatcagagtggaagtagccatcattcaacattactcccagatccttgccactcaaaatgttgtctctggctcagcagcaacagtatcatctggcacctagttagaaccaccccacacctctcagaacagaacccaagtttttaccagattgcctaatttatgtgtccaaattaaagtttgagaagtgctgccctggatatgtgctgtccattaccaaagttactagccacatgtatctgttcagctattgaaatgtacttattgagactgagagattgcattgtaaaaatttaatgaattaaaatttaaaaactcatactcaattcagttattggaatacttttcaatacgtttgaaacaacttaggtacacgaatctaaatatagataagtatttctggtgaaaatatagcatccaaattaagaagtaagcataaaatacacaccagatttcaaagacttagtataaaaacatttacgtaaaacatgtcattgaaaattttatgattacaggttaaaatgataaaatttcagatatgttgggttacattaaatatgttcttaaaattcatgtgcttgtcttttacttttcaaatgtgactactaggaaactgcagctcacattctatttctactggacagcattcctttcgatccatggttctcaaatgtaaaattagtgcctggctcccactcccagatattctggtaaaattggtctggggttgaactgagcattgggatttttaaactcttcctggtgattccattgagcttccaaagtttgagaaccaccaccctggattaataacagattcattaattctgactaataaataatggcctcataaagtctttatatcttttgggaactcccatcattcttcaactaaaatatagagctgggaaagtagtaccatttcttaagatcaaaaggctggaagtttgggtgatattattctccttcaacttcaggcagagttaaatatacccaaccagatgaaaatcaatgttctttaatatcttcagaaactggccaccagttatttcagcagttcatttctatatctaatgtagtggatcttagacttctgtgcatttagaataatctccttgatagtttgttcaaaagcagattgctgggccttagtgagtcacaggagttctgtggtagggtgaccaagtgtcctgatttgcctgggacttttctgggaattgctcggtcctgggcaaagaggggcagtggatcaccctaacccagggaagtgcattactaacaagcagtccaggtgttacttctgagcacagtttgagaactacttctagaaacacaggctctcaaatactttttcagtgatactctttctggattaaccaactgtcctaggaacacaaccaacgaagttatacaaataaccagttcagcaaacaactgattgtggaaattgttctaatataattaagcatgtcatcaaattgctttaaagtgtatgaaagaactataaagagatcaccctgatagccttgatgagaacaattccattgtcagaaatttagcagattgagaccagggaggcaaagtaagtatgtggcttgaagtcatgtcaacactgagtttgaatcacagcttctgccatttgctagctgtgtaactttcaggaagttcctcaacctctctggatctcagtgttttcatctataaaagatgaataatttatacttacactgaaggctaaggatgagaatgagaaataatgcactacatcagatgaatcccagctgagggacattctacaacatacctgaccagcactcttcaaagctgtcaaggtcatcaaaaagagggaaagtctgagaaattgtcacagccaagaagagcccaaagagacatgataatcaaatgtaatgtggaatcctagatgagatcctgaaccagaaaatgtatattagataaaaactaaggaaatctgaataaatcttgggtgttggttaatattattgtatcaaaattggtttatttcttgtgacaaatgtaccatactaatataaggtgtcaataaaagaacaaaatgggggtagggtgaatggaaactctctgtatatctctgtgacttttctataaatctaaaactattctgaatttaaaagcttactacccccaaaaaagtgtctagcatagtagtgtccaggccagaagtacacagttaacaattgttgttactaattttgtgaattgtacattagaaatgatgctaacaagaagaacatcatcttgattcaacatctttaggaggaactatgagcttgaaacacttggacatcagagttgagagaagaggacaaaaggcaagatgaatgggcatgaagaccctcaaccatgttacttctgattggctttctttctggcattattcaaattctgtacttattttattcattcatctgttctctgctttgagcccaacgtctcctatctctgccccagaatataagctccttggaggcagagactttgtctttgtcacttctttatccaccatacccaacacagcacctaacatagcatggaaattttatctgaatttactacactgaatgaaacgattccattggacatcaaagggcagaggcaaacactctggactggatccagagtcctttttatacatgttttcttctcctagcttcctcgtagctccccacctttcaaaaaaagaaaagcaaacaaataccaaccccactctactgaccaagtaatttactttagggaaagaaaagacttcaacatttgggtccagatttgctctcttacgttctagcttacatttgcaaatatgggtgacatggctgaaacagaaatgtcttggtaattacttgtgctatatcacacctcgtgttttctagtcaatttaagcctcacaaaaattttgttacataagcagggcagatgcttttacctccactataacaagagatataaaatataaagctttatataaaagagatataaaatttttatatgaaaagattatttttataaaaagatgttttttaaaagaaggaaggaatttaaggtggcatcatcgtttacccagctaattcacaggggattatattattcttccggggctgccataaaaaaaatcccacagacagtgatttaaaaaacagacttgaattctctcacagttctggaggctgaaagtccaagatcaaggtgcaagtggttttggtttctggtgagccctctttcctcagatcactgtgctctccatggtcctttgggtatggagagagcgagttacaagccctggtgtctattcctcttataaggacaccagtcctcaccagtcctatcagattagggccccactcttaatgacctgatttgaccttaattacctctttaaaggccctatctccaatacagtcacattaagggtgaggcctttcaacatatgaatttgggggaacacaatccagcctatcaccagaatgttctctgacaacaggcagaagggttaccaggatgagcaaggaggagctaacacttatggaacagggaggaactaaccattaaaccaggggtcagaaaactatggcctttgggccaaagttgagggccaccttcaggttgtaaataaactttcattggagcacagccacatccattcatttacacattgtctgtggctgctttcatgtagagttcagtagttgccatggagtctatggcctacaaagcccaaaatatttactctctggcccttcacagaataaatgttctgactcctgagttagatcaatatatgagtgttcattttctccatgacataatgccataaagtcagtgttcctgtcacttcaccaatgaagcagtggaggctctgagagatgacgtgatatccacatcacacagctgacagtcagagagcccagagttggagctctacgactccaaagggtgccctttccagggcacctcatctctgggcccagggcttttctcctaggctcggaatggtgtgtggatatggctgccagcctgtggcctaggtaagtcatcccatctgcacaatggcttcctacaatcctctcagcctcgaagatcaagaacaattgtcattcagaccagaatgtcccatggtttccattcacaccttatcagcagttgactatagctatttttggccctcggtttcttgaaattttattttgttttggtttatgttttatgttgcggcatgtgttttatatgactaagattgacttagaaagcagatcatttgcattagggagccttgcaaataatatgtagaccttaagaggtttctagggataattttgggacttttagccccaaatgcaattgttggtacttttcattattaaacagaatgtttccttttcatttcagcattcaatattgaactcctggtgctttccttattgtaggaataaaagaagcaagtgaatacaactcaggttcctctttatggacatttgtcaatagaaaacagttccaagatcctctttgaattagtagaggcatttcccaaattatttacacaagaatccagagctttttcattaggcctatgttagaatctaaggaagcaaaacagcaattgggattaattttactattggctaatggattacttcctgtttccagcttgttgatcttcctgtccatacagacaaatgatttgcctggagattcatgctgcttttgtctgttcagcatcatttcctctgaggaacatcctctcccccatttcaggtggtcccaggtgggctgtcaatcacaacacaccagacctagccaatcatattgcctcacctccccagacacagtaattgattcaggggaaagaatgtgacccagtcagagcaaattcccccaaatgttaaagaagttaggagagaggccttcaaactaagtggcatcaggccaagagatagaggcagaatgactggatccagcccttcctgaggctttacccaccccagacttcctaagagtgtgatcccaaaatttctttttctgcttaagttaactcaagctggacttctcactcaaaatccaaaatgtgctcactaatataacatgcttccaggttttctgagtgtccctcagaaacatgtgtcagcaacttccagaggacatagggcactgagcattgggatccatgggtccttatcttagctgcaatcttagagcccttaggtcatccctatgccaagttggagggcttttgaaatggagagcctgttacacaggggatgcaacatgatttcatggatatatttatgtcttatgcacaaaagtgcattctagacttgctttttaagttccatatctctttgtcccctttggcccttcctggagtggaagcaggacaaattcttgtgctgatgacacttttttttttgagatggagtctcgctctgtcacccaggctggagtacagaggtgctatctcagctcactgcaacctccacctcctgggttcaagcgagtctcctacctcagcctcccgagtagctgggattacaggtgcatgccaccacgcctggctaatttttttttttttttttttagtagagatgggatttcaccattttgcccaggctgatcttgaactcctgacctcaggtgatctgcccacctcagcctcccaaagtgctgggattgcgggcatgagccaccacacccggctgctgatgacactttattggcaatcttgggaagggaaaaaagaccaagtagaagtagcaacgggacccctaacattgatattgcctgatgactgggctggccaaagtctggtgccaggacccctatcctaccagtggttccagacaccaccgagggaatctggaaggagaaataaagcccacaacacgccaccaagtggctgcaatattactcttgcagtgaagatactttttttttcctcctttgtttccatagggtacttttctaaacctgtccaaagtccctctcactagattccttaactgtcacttaaagtgttatctatgactcagaatttcctaacataaattctataacctccctcctttcctcaggaaagttaccaactgaggcctactcacaccaaaactctgatcctagtggctgtgagatgtctgaatgctgtttaaactgtgcacttacatgtgtttgcaggtagtgataaataagaactcttctttgttgtcgtgcttattcacagtttaacttggcttcctctgcttcagacagaagggaactgaagtaaattcttaagacacacaaggaaagaaagttctttgcgctgaaggcggttcgccaaggtgctaattccatctttggtaggtttctcccaggactgtgttcctcatccaggaatttccctgagcttgatgggtcacacgtccaaattccagctttgaataaataaaccaactaaagtgctcagttgcctcagggattagcagagcagttcacgaacttccatcgccccccagtggcaattagttggatctttttgttagggattttcttatgcttaaaatttaggttatcgttctcccctccaaagttgttttaagtttttgtttgtttgtttgtttaattctcacactgaagattataaagtctttgtgtggaggtatgttggtaatgtcaaattaatggcttctgggtcaccaggtcatagacggataagatgtagtatctgctttcatggttctaagtaaaagactgattttcaacctggtctctattctgaggctccatcctgagagaaggtgaaaataagcagcactaaatcactaaatccagaaaggactctcagtgggtggcatcaaggtaacctagagagccagttagccttggttgcatatagatgagaactcagccacccacagtgatagtatctactctgaaaacaagatataggctatgtgagattccaaaaataaaaagcagaaactgtgttgagggagaaagcttatatacatatgaagtagccaagaaacacttttctagcataataaattcataaattcatgcaacatacagtcaatgatttttgatagctagcataaagtacttcaccttgttttatagaaaaagaagaagtggaatttaggaaagtttagactgaagaggcttatcttcaactcaaaaaagggaaggttcttgcctccctgcccacagtggagttagtacttaagcttatttttcagatcatagtaaattcctttggttcaccacctgccatgctccacccccacaccccttttaaatttaaaaccaggtttgtagtcctttaaataatactgacccagttctaaattcctacacaccaaacagtcctgccaatgctaaatcctgagtagaagtgtttgtccttcagcttcctttactcagaatttgtctcctttccagccagaacattctccttccctggccacccctctccccttggctttggaaggcaaactttacctaatctgttttgtttaagaatcctaaatcttagtggtttaagggcctcagtattagtacacacaagcacacatatataaatttaagaacaaagaatgttttattatcagctcattgtattttgtataatatttgtttaataaattcacccttaaagtataagcctctgtcagttaggcctggcctccccatctcctggaccccaaggtcttattcacttgaatctcccagtccatggtccatggaatatcaagtttccctgagttatatgttactcctcagggacttaggctcctatggtcacttctgcctctggactcctctctctgcttgtgctggctcagtttacattgacctagaggggaaactctgcccctttatcatcttctatgaaaacccattcactaaattacttgctgattttgtaaaacactcataacaaaatagagatatatggatacttcttaaacatgacaaaaaactttatgccaatctaaaagttcgcaaaatgcttaatggatagacactagacacttttccacaaaaattaggaatgtctactgccacttttatttaacgttttgctggaaagtcttagcctatgcaggagaaagaaattagaggcatgaggccaggcgcaggggctcacgcctgtaatcccagcactttgagaggccgaggtgggcggatcgcctgaggtcaggagtttgagaccagcctggccaacatggtgaaaccccatctctactgaaaaaaaaaaaaaaaatacaaaaattagccgggcatggtggcaggtgcctgtaatcctacctacttgggaggctgaggtaggaggatcacttgaacttgggaggtggaggttgcagcgagccgagatcatgccattgcactccagcctgggcaacaagagcgagacttcgtctcaaaaaaaaaaaaaaaaaaacaaaagaaattagaggcattaaagttggacgggaggaagtaaaatcattattagttgagattatatgaaataatccctggaaaatccaaaataaacacacaaacattaagactaaagacaagagaatccaaaacataggagagtataaaatggatgtagtcattggagcttgtctttagtccattttgtgttactacaacaaaatacctgaggctgggtagtttataaagaaaagaggtttgtttggcttagagttctataggctgttcaagaagcatggaaccggcatcttctcagcttctggtgagggctttcatgttgagtcagcagagaaagtcaaaggcaaaccaggcacatgtgaagagagagtaaacatgagggggatcctcactttgtaacaatcctgctcttgccggaaccaatccattcccgagaattaatccagtcttgtgagagtgagaacccactaccattagaaagtcaccaagtcattcatgaaggatttaccccatgacccagacatcttccattaggccccagctcccagcactgccacactgcagatcaaatttcaaaattagctttgatggggacaaacaagtcatattcataccatagcacagctataccttattcctttcaccaggataagtttcaaatatataaatggtttaaaggaaaaagtgtaatttttttaattgaagaaacttgggagaatttaggacttaaaatatttttaattatgccacaacatccagaaatcatagaagattataaaattaagatccataaaaactactcaaagcaaaacttagcagaagcaaaaacaaaaaaagataattttagaaaatattccaacctcatagtgtagaagaaaggttaatttccttataaagaatgtctacaaatcaatttttaaaaaaagcaatacactgtgttgatgaaggtgtggaaaaacaggcactctcatccactcctgagggaagctacaaggggtacaaccacctatctcgggtcatttagaagtgactatcaaagttttaaaagcacattccctttgacccagtcattttaattctaggtattacaaagatatgctcacacagtgtgagaaatgatgtaagcacaatattactcattgtagtattgtcgtaataggaaagtattggatataacatcaatttagttgattagtaagggaccagttacataaactgtattaatctatatgatggaatagtgtacatgtcctaaataaaaacaaaatggaacactgtatgtactgatatgaaaatttacattttaattcttgaatctgttaaataaaaagaaagatggatatggaaaacctccaagatattttaggtgaagaacaacagttaaatccctatataaagtatgctactacttgtgttttaaaaatggggtccctcaaagcacatttcttggaaaactgcatttcatgtggtggtggtagaggatggtttgtcaacttgtcttttgcgggtttaatctttcaatcccactttacaatgagtccaaaccactcaaagagccttcccttccttcctttaaagctactcatgccttgccttattgattttccttccattactcctattttctccaagtcattaattcacaatgtttagaataaaaaaataagactgccaaggaggaagaaatttaggttggctagtgatgcattctcttcctaataggaaagccaaactaaagtcgcaaagttctttggtaaatttggaatgagagcaaagaaaaccaaagccttgaaggattttaccatccattcttatgtcttaacatccaaccaaacctgataatttacatttctttatctgcaaccagctctttcctgagttctaattctgtgttctgaaccgcttctgggatttcactgcctagataaccattatcatctcaagtgcaatgtgtctaacctgaactcatcttgcccctaaccctaaatatttctcaaaatcagcagccatttttttactcctgtcttcttatttacttcaccttagctttctctttatgcagtaaggtggtaatttcaaacaactgtaatctaccatgctcctcctttttaaaagaataatatgtcagaaggtctttggttacagtttatgctttaaaaattggagggcaaatccaatacccactggaaatttcattaacataaccccgtggtttccccatttctctctaccattggtaaccaaatccactactaattatttccatagggaagaaaacatgaaattcctcactcctctaggcaagactatactgatatctctcctgcctgtgtgggtggtgattcacatggctctccagagctcctccccaaagcaatgttcacttcacccattcttaccagtgctattcccatcttttttggcacatcatgttaaatctagtgactcataaaggcccacttgtggcaacaactggatcagcaacttaatcataataacttcaataataataacagttttcaccactcgaaaatagcgagtccccgcccccatttctgcttctgaatgattgtgtgtgttggtttggggtaggtagaaagaaggggcaatgagttaaatagtcccagtgtagttacataatgcacactacatgccagtatgtttgcatgtgtgtatatatacatatattgagcaagctgagaaagtagaagcccatgctctagctgccaggtatcaagcagaggaagtttctggcctttggttttccaagaatagggtccctccactttaatattattgacatttggggccagataattctttgttactagagttggcctttgccttgtaggatgcttagcagaatgccagacttctatccacttgatttcagtagcaaccactaccctcagtgtgacaatcaaaaatgtctccagatattgtcaaatacccccaggatagggacagcaaaatcagctttagttgagaagcaccgccatagagggaatcagggccctgtctcctatcaaatctcatacctgctgaatttcccagcatgagaagaggctgggcaacctccctgttggcattcaccaaagaatagccttaagttttctgaattgacctaattgcaggcccattagtgcccactcagaccaccttggcaggtatcaaggaaagtccagtcttaaataagtacagctataaattaaagaaactttctcaaaaagcaatgccctgcatgcatctggagacatgaaacaaaggttccataagaaactgggagtgtacatctggagacatgaaacaagggttcctataagaaaccgggagtgattcctcatataaggtagtcatccacaatcagtgaattaattaattcaatttttcttttgagacagattttcactctgtcacccaagctggagtgcaatggcatggtctcggctcactgaaacctctgcctcccgagttcaagagatgttcccgcctcagcctcccaagtagctggggctacaggtgtgtgccaccacacccagctaattgttgtatttttagtagagatggggtttcactatgttggccaggctggtcttgaactcctgacctcgtgatctgtccgccttggcctcccaaagtgctgggattataggcatgagccactgcgcctggccaattaattcaatttttagaggtctatgtgaagaaaccctcgactctcatcaaaacacaaaaaagcttgggacttaccaactaataataatatatcctctaaagttattacaatggttgtgagaatattaaacagaatgataacctctggccatctctaattttattggcaataaatccctttaaggaaaagtagtgtttatttccaagagcaagaggtaaccctggcctttgatgtagacacggtccctctgagtacacatgtgatgaatgctggcagactccatggaacacagacctattggtggggggtctactggctatgtcttaggaacttaccttcattcatttaggccttagcaaagatcacagtctatgaagttcatgggcagtgctggcacagaaccaagtgaaggtctccaggcataactagaaagtggtgaagagcaaagttgagaaaaacaagctatctctattgtcagatcaaataattcttctttttaaaaacccttccatggcttcacatttcaattaaaagaaaatgtcacttcctcctcatggcctatggcatgatccagccccaacatcacctcctactattctgcccccaactcattctgtgtgggccacactggtctttccctgttctttctgatctcagaacattttaccatggcattctcattgtctggaccactctttgcattgatcttcacatggctgggtccttctcaacattcaggtctcagctaaaacgtcacccttctcagagaggtctttgctgacaaccatatctgagaaggtatcctgagctctcaatctgtatcgtgcacactgatcatctggggatcatgttacaagacagactttgactcagtggttctggggagggacttgaaattctgcatttctaacaagctcccgaggaatacaaattttctgctccacagatcatctacccacaggggtgggtagacccccatgcctcaatctttgtcacactacctgtgtcatttaattggtggcttttatcaggatcttaaattatttatttatctgtttgtgttggattgtttgttgtccaatctattcatttactagaatgtaaattccctgagagcaaggagtctgtctagcacttttaaattctcagcacttcccacagtacctgacacatcataggtgctccataaatattgctgaatgagtgaaacatcactcattcaagattcattgactctgtgatcccttccagtgtctgcttctgactgcttcagtgagcactcaattatacaacagaaactacactgtaatgatagggcagtgctacccaagtgccagtccagaaactgctagttattggccaacactgaattaagaatcttgtactataatataaatctgctatgccactaagcacaattttatctgagatgagacatttttcatagtaagactttctggatgaggcaagcaatgctttgccttgccttgtggtgaaagctcctcatctcatattagaagggtaacagtgtgtgaactggtccccactggcaagacacattttgagttgtgctgatatagcggatataaagccaaataagatctattttttaacttcagaaaatccatacataggtaagagaattacacattcaaatacataactgcaaatcttttgtcaagtgctataatacggaattaagtggaagaactcaggaattgtagaaaaaaacaaataattggtcttttgtgctcccccttagtcacacctttcctgacacctgctctcattataaccacaaaccctcccaccataccccttcctcctgatcacataccactcatctgggcatgttcttccccttgggccctgaaacactgaagttacaggaccaggcttgggtcttctgagaaattgtgaaagggaactgagaattgtggtagagaacagaaaatgataggagagatagggaattgtgggagaagggagaattgcgggagagaataaagtatcatgagagaacagagaattgtgagagacaatgtggaattgggagacagactaggcagctgtgaaagagaacagaatattgtgtaataagggagaagtgcaagagtggagaattgtgagacagagcaaagaattgtaggagatacgaggaattatgggaaagacaaggaattatgggaaagaacagagacttgtaggtgagacagggaattgtgggagataataaagaaagggggaagacatcaggaattgtaggaaaaaacagagaattgtgggagtgacacaaaattgtggacacacggggaattgtgggagagaagggagaattatgaaagagaagagattattgtgggagagatgggaaattgtgtaagagaatagagtattgtgagagaacagaatgatgagggagactaaggagttaggggagagactacagaattgcaaatgaggatggagaattttaagagaatggaggactgtgagtgaaagtgaagaattatcagagagaagaaagaattaggagagagatgtggaattatgagaaagacaggaaattgtagcatatgacacagaattgtgggagagagcagaattgtgggagagacatagatttgtggagaggacagcacaaagaattgtgggagagacacaggattgtgggagagaacaaaaaattgtggaagagacacaaaattgtgggagaaaagggacacttgtgggatagaaaattgtgaacgagaatattgtgagaaaacagaattatgagagagaatgggagttaggggagagactggggaattgtgaacaatcatggagtattttgagggaatggagaattgtaagagtggagaattctgcgaaagaacaaagaattgtgggggagatggggaattataggaaagataggaaattgtagcatagaatacagaattatggttgagataaggaattgtgggagagaacagagaattgtgagaggaaaccaaaaattgtggggagaaacatggaattatgggagacacagggaattgtgggagaacagagaactcagggagagacaggaaattgggggagagaacagagagttctgggagatacagggaaccatgggagagaatacagtgttgtgggagagacggaataattatgagaatgaagggagaattgtgggagaaaggaaatcatgaaaaagaatattgtgaaagaacagaattatgagagataatggggaattatgggagagactggggaataagaacagagtattgtgaatgaacagaacattgtggaaatgaataattttgaggaattgtgacagacagagtcatagggaatgatggaaaagacagagaactgtgggaggaatggaactgtgggaaacagaattttgagagatacaagaatttgtaggaaagaataaaggcttgctgggaaacccagcaaattttgggaaaaacaacagaattacgggcaagacagggaattgtgggacagaaaagtgaattgtgggagacacaaggaatcatgggagaaacaagagaattgtgagcaagacaaggaattgtgggacagaaaaatgaattgtgggaaggaatagaattttgggagtgacatgggattgtgggagaaataaggaattgtgggagagacagaagattgtggaaagaactgagaattgtgggagacagaactgtgggtaacaaaacagaattgcgggagtgaaaaggaattgtgggagggacaaaagaattgtgggtaaagagagaagttgagctgtgatagttgaaatggaatccttgggctatcctgtaggcagttctgatgctgggatggcccttctgagttgtcccctttggggctaggggcctggacttatgtgcccttgcagagaccctcataggatgcagatcgtccccaaggaggggaagtgattttgtgtgaggcaattctcttaggcagaggacaattcctggagactcagctgaaagctgtgagcccccaacactttctgcaccaggggacatctggacgtatttcacagagccactatagttatatagaaagatatatgtttctttattaacactttaagtaacaagatcaaattaccttaatttcaaagtagtggatggatgatattttgagacaggcacaacaaccatatgtgacataatttatctgtaatgtgtattagtgccacatacagctaatagtactaggatttattgcctacatccctgatggaagaaaatgctaaatttctgttggaggtaaatgaaaatacagacattcaaaatcacatacccagttaagaagaatttagcagccagaacactgtcttgttcacttttggatctccaccaccgaagttatgggcacctactaacgtttcttgaatcattgctacaattaaaaccgataagatttaaaaaaaaaacaaatttaaaaactcctccaaagcactccttctgccgcataaagcatacatagtagagctcttcactctagggaagcctctggagcagacaaccttccctgccaccgccacattttgaaaaaggctcctggcctggaggggcgggcccagaaagcggcccccgcagcagttacaggccggggcgaggaggggacggaacccgctctccgtgattgacggaaaatattactcttcagcccgcctcccgcgtgcccggaagtcccgccttctaaaaaggaagtaggggtgcgtgagaacgccggcggtgaccgcagccacagcggtgaccgagtgagaggaaggcggcggcggcggcggcggcggcgtgaagtcactgctgctctgggttcgggttggcgactgaaggcggtaccggcctcccggaacagcccgggggagggcttaggtgcagaagggcaggctggccgcggccggtttggtctggggaccacgggctggagcaggtgggcaagcgccgggacggtgtggggaagacacttggcagcttctcgacctctggtgtcccttcgtttcttcgaattcctattcatgcgccgcacccttctcggacccccagcccctcgctaaggctctggggatgggggtcaagtctaggctcaatggacctcccctcctccacccgggtcaccactcctcggaaatcctcgccccactcccgcctcaggcctgtacctcctggctgtgacgtggtttctcagcgactgcctcacctcagtcccaaaatcctcactgccttagatacatacgtgcccccagaggttggcctgggtttcacagtatttccctaagggggcaatatattaaagctgtccttcgaagttagtaccctgcctggtagatgcccatgggatgacaaagaggaggaacaagggttgaccagattaggactaacgagagaatagtctgagtccagagacattaatctgtctctttgttttggcaggtggaaatttaaaattgtttacagtcaacactgtttccagccatgggtttgtctccatctgctcctgctgttgcagttcaggcctcaaatgcttcagcgtccccaccttcaggatgcccgatgcatgaagggaaaatgaaaggtaatcggccctttgcctagaaaataaaaacaaaagataattcacggctgggtgcggtggttcacgcctgtgacagcactttgggaggccgaggtgggtggattgcttgagctcaggacttcgagaccagcctgggcaacatggcaaaaacctccctctacaaaaaaatacaaacattagccagacgtgctggtgggtgcccgtagtaccagcgactttggaggttgaggtgggtaggatcgcctgggaggccaaggttgcagtgagccaagattgtgccactgcactccagcctgggtgacagagtgagactgtgtcttaaaaaaagtctggaaagcctctaaaggaagaggcagtgtagtatgctgctgaggctggtaggcatgggagtcaggcaccctgggtctggtcgttattttgcgtcttattgaggtttgtgactctaaacaagttaactctgttagcctcagtctgtcatctgtaagatgaagatataataatgtttcacaggcctgtcatgatgattgaggtagtacatgagaacgtagtgagtactctaaaccagccccaacttcccaaagtttacttgtgcctacatcagtggttcttaactggaggggggcaatccccccttcccacaggggacatttgccaatatctggaggcatttttggttgtcacaactgagaggaaagtgaatagagggcaggagtgctcctaaacatcctacaatgtacagaacagccccccaacaaagaatcagctggccccaaatatcaagagggccaaggttgagaaaccttagtctagatctagctgtcttaataaataacttttgctcgtatagccatttcagtattttcgtatataaaagtaagccatcacttaacgggcttgctgtccattctttagataagaaaatgaaaatggaaaagctgtctttcatttttaattcattcatgtctactttagattttttatattaaagtgtggcttgaatcagtaagtcgtgaagggcagaagcaacatggtgtgcttactgagtactaatgtttgcgctgttattcatttcttcagtcagccagcctattctgagaggtcactgcccattctgtaccaagcattgctggattttgtttgtttctgcacgagagaataacatcatacaaaatggagctttgcctgatagagcttacattctcatcttcataagctatgtggtcttacgacttcataagctaagttttctccctattttatagtcaaggaaactaagacttggagtaactgatgctccaagtcacatagtaagtggcaaagccagcaaaagttctgtgaccttggacaaggacaggcagtgttcttctggggtttctttgtacaggaagaattgagacagatcagccaaagcaggtgtgctcctgttctgagtgtcctcagggagattctagaacccttactttggttttatttcatttgctgtatatcttggagagctgccagacttactacattaataaagaatgtgggtgtctataggagatcgaaggggctactggttatatgacgtgaaaagttgaaatgttattttctttgtaacacccagctgggatctatgacttggaaaggattggtgctttcagtggtagagaggaaaggcatagcaagtcttccttcacccctaaagtgggcagtggcacagggcaccaggaaatgagggcttgggaggagaagtgcagggaaggaagtgaaagcaaactcagctttttcatgtgtattgctgtagttgctgctgctgctgcctgaggccaagattccattacatgagcagctgtcttctgtgtctcagctctccaagtgcctgctcattctctgaaccagtttcccagtccctcactaattgggatcagcatcctgggtctttgggcatagcccttgctattgctcatctcattaggctcagaccttccctcgtaatgggcatcttgatcctgtatgggttgtggaatattttctttattgtctgtcttttcctgttaaactcttgccattgactgatgggaataggccataggccacgtggttttcctgtgccttgtttcagtcttgagacaaagcagagtggcattcagatttttttgcagtagcctctgtgatgtctcctctgttcattttctcctccccttccttgtacctgagataatgcatcagtaatgaaagcctggattgcaactgtgtcctgattggatctgggcttctctggaactagtgaatggaaagtcaaggagaccctgtgaaatgtggctggtcccctcttaggttcctctaacagctccccagctgctcatccagccaggttactcaaaccatggcacagataacacatgctcttgcaactgccaaggttttttggcttatttttgctgggggtgtgacacaattagagaatgtatactcatttttctttcaaaggaaatgtaaattttagaaccttctcatctttaggattttggaatgttagctagttcagttcttgatagatttaaacagaagaaacctggcttttcctatggtggtaatcattggtcagaaattcagctctttagtgctccaattgagagagttagatgtcctgccttcatggtgacaccatttttatacttgattatttcaggctgtccagtgaatacagagccatctggcccaacctgtgagaagaaaacatactctgtgcctgcccaccaggaacgcgcctatgagtacgtggagtgtcccattaggggcactgcggctgagaataaggagaacctagatccttcaaatctggtaatccacactcatcttttctttctggagctttttatgcagggttgcttatacagactcccaagacaagttgcaaatggctaggatgaattcttctgtcctttgaaaacagagaagttagatattctatctacagtgaaaatctagaatgtgttagtaagtgtagtttcagggagtgcctgggaaaaaaaccagagtgattatgaggagccagcatagttgtactgggaataagccataccaaatgaatattttcttctgggacagttactaggtggtagatgggaaattctgtaagaaccatagctagagttagttaaggtatctttggtctggggaaactttgtagacacattacatgattggggaacttcttcaggtacaatagggtgccagcctgcccgagtcactagggtggttcactgtcgtgtgactgccagcaaatttaatgccattgagaagtgagggcaaggttgatgtgacatcactacattttgtgatagacaacatcagaaattgtggtctaaagtttggaatcgtgttttaacgggaggctcaggcatatacttcagagggccacaggattatcaagaatagaaattttagtgaaccagacagcctgtaaagaaactagaaatatttagcctggaaaagaaagggcgtgggggatacaatagcagcgtccacctcaggaatcaacaaactatggcccactgcctgtttttgaaaatgaagttttggacaatgcaccaagattatcttgcacataggccttcaaatatttacaccagaggtcattggcaaactgcttctataaagggccaggtagtaaatatgtttggttctgtgggccgtagggtctctgtcacactacccagttctgctgctgctgctttctctgtagcatgaaagcagcgacaggcagcattatccgaagcccctggcagaccactggcctagatgatctctaataggtgagtggttcagaacatgggccttttggaaccttacagacctagacacttaccccatgggatcatgatatgtagtgagaatgtgaataacagctaacttttcttgtggtcactttttaaaaattttttattcaaggctagccaactgaagcagtgggagaggagaaggaacaaagaaatctgtaactggttgtgatcaattagtcgtaaacactactgtactcagaccagcctcttttggtcacttttctagcgtttaagctaagcaccctacattctcccctttaatcctcataacaactctgtgcagccagtattcttagtgtccccatttcagagctaaagatactgagagtgaaggagtcattcatcccacatcaccagctaggaaatggcagagccaaaactgaatccttatccacctcagacccatgttcttaaacacactgtggtgataatgcaggtagaatactctgcagtgcctactacacatagcccttcctgctgtcggtattctgagggccttgttgtgatggagacttttaattaatgtttactaggaaatcctttatacttctaacacagaaagttcaaggccagtcattcccaaccttgggtgattttgcccctcaggcaaatatcctgctgaacatcctgcagtgcttagaccaccataactaaaaattgtccagctccaaatgtcaatagtgccacggatgagagaccctggctaaggctaagtgctagcataacagtattggtgacccacatgtctgggagaagggattcttcccaccttctgacctcgcagcgttgagatgcaaagactcatctgtaatatattttgcctaagggatgaagcataagcagaaacctaaaaaatctgagaatatttttttaaaaaagcattgctgtacatgtgtgctatgagagttttccccagagaatgaatagtcatttttgaaaagcttgtcgtaaagtttttagaaatgcctgaagatcgtggcgttagtttctacttcttattccttggtgacattacttctaaatttgttcaaaggagaaagaggccaaaaatttaaccacagtgtttaccatatttgagaacttaatcagtgaagaaacacaacctcagtaatgtgactcttcaaaacagtcaaattatgtgagaagtctgaaattttgatgtcactgatttaataagtaatctgtgctttttgtgtgatgtattgctttccaggaagtagttaattatattgccttttactttatatcctataaaagcaaatctgttcattttatttagatgccaccaccaaatcaaacaccagctccagatcagccatttgcattgtctactgtcagagaagagtcatccattccgagagcagattcagagaaaaagtgggtttacccttctgagcagatgttctggaatgcaatgttaaagaaagggtgagtgaacatattatttaagataaaaatttcttgtcagaatatccaagagttatatgctaaagagattttttaccttcaaaacaatatagtacatttttatgtattaatcagtttataatcacctgatttttcacacctgtcagaatgtaagtgcgagaccagtgtattaaatcagggttctcaagagaaacagaaccaataggatatgtgtaggggggcaggagacaaggaaggcaggaagatatttattgtagggaattgacttacacaattatataaagctgtggagtcccaagatctgtagtcagcaagctggagaccgaggagagccgatggcacacttctggtctgaaagccagcggtctcaagatgcaagaagaactgatgtttcagtttaagtccaaaggcaggaaaagtccaatgtcccagctcaagcagtcatgcagaaggccttccctcttactcatggaagggtcagcctttttgtcattcaggtctgcagctgatcagatgtgacccacccacacggagtggggagggcagtctgcttcacttagcctactgattagaatgttactcacattcaaaaaacaccctcacagacacacccagcataatgtttgaccaaatgtctgggcatcctgtggcatagtcaggttgacacataaaattaaccatcacagctagtaataggttttttaaaaaactgaaaacactgttagataaaatgtttagaaaaagttaggggatcattgatcagtggtactatctgaacaattgtcaccttaaaaatagatgattctgtaagtctggtttactgtgactcagtaaaatgagactaaggtgaaccttttatatttgttttcaatgcttctatagtagctttggatttatagtgctgctccatgatcatgggtaaatcttgaaaatgagccttagatctgttaaattcagagaaaatgagcattcttagttctttctcaaaggggaatgttgaataaatcatcttatgaaaatatgtggattaactttatggcattatcaggaacagttgtcaaattttaccaaatattctttcctaggtggaagtggaaggatgaggatatcagtcagaaggatatgtataatatcattagaattcacaatcagaataacgagcaggcttggaaggagattttgaagtgggaagcccttcatgctgcgtaagtatgtttgagatcttaaatgtttcaagcatctttgttatttcatatcagctttctagagttttaacattcaaatcatttgttctaataaaacattttatgtagcaggcatggctcagtgacaattgttgcatgacaggccacccttcttagttgaaaaatagcaaccattttattaggcttgtggattcagtgggtctgggtagccaaggacagggcaaggatggcttgtctctggtccttgatgtctggggcctcagctgcaaagacttagtggtcaggatggcttccgagccgtgggctagagtcttctgacggcctgctggtttactcctctggcgagtggtcatggcctctgaatatggctgttttcggcttcgtcatatggtggctaggttccaatagctagagttccaaaaagcatctctatctccattttctgacccagcctgggaagtcccaaagtgtcagaagcctgcccagattcaaggggaggggacagagaccctgcctctcagcagaaggagcattacagcccttcgaaagcagagcatgtgggaagggagatgctaaaatgccatctgccccaagggaggtgggaaagacatttttgttccctcaatagcatttattgaatccccattaggactaaacacaaagagatgtcttaactcagagctctttttctcaaggagaataggtaaatgcagctgtgtgtgttaaaggagacaggacttcagtctgttgagagtagtggttctcacactggagcgtgcatcaggatcatggggaaggtttgttaaaacccagcatgctgggtcccacccgcaggatgtctgactgagtctgtttcgggtggtgcctagactgggtgtatctagaacactgcatatgctgctggtttgagccagattatgtcataaacagtggttttaaattcattgcacaatgcgattaattaatttcttggctaaagtccacttaatgatttttttaaggtgttttgtttgtttttaatatttgcactctgaagttcattggttgcactccctggctgtcacaggctgggcctcaggcctggggtgggtgcatgtgagaggggaacaactgcaaccgtgttgccctcagtaatctctggactgagaggagccacaagtgtttgcagtgacctactttgaaagtgtgttctaattaagaccacctgctaattacttgtgtgattatggagcaaagcgaagagagaaaagggaatttcagtttgtcagtttcaattccttctccagttattttctggacggtcaaaattaagtagaccgtttaaaaactcatgctatgatctccagaagaaagttttgcctagattgagtttacctttttgcctgtgatcctcttgagaagagatgttaaggagaggagtagttcctaaaaggagaagaaaagtaactcataagtcctcaaatagaagtcctttatactttggaaatttttctccctcccacttacttagacacctatcttgttatccatgggagcagctaacaatataggtggcctgctgacttggccaccactccctctgtctcggtaacagctgtctgtctagcctgtaggtgggctgtgaactccacgaggacagtgctcagagggtcttgtatagcaggtcagtgccctgctataccctggtgcctacagagggctggcacctagagagtcctcagcaggggtctgcgggtagagggagtgcatttgccagctaggactctgccactcctcatcttatgtgtagttattaaggagctggtccaacattaattacaatccatttctagggattaatccatcattttcttttcttcataaaggctgttcattggtttgaaatgaaagaagagtataggattttcttgtttgtctgaaaaaccccagctgctctgtgccaaaaagaagcatgatgcacaatacttgaggctgtttttttttttaatttgcctttcctcctccaccaaatggaaaggccctgtttcctgactcctcaaagtgcagtgtagatatccagaaggaaggggaggcaatggaatgcaccagtccagaaggaaagaggaacatttttaacaaataggcacttgttgtttgaattattttagaacttacctttctctgtaaatgttatattatgtgaaatgtatacaggaaaaaaatggatattactaaaaaattagaacatcatctttgtcaaagaaaagaaaatattttaacagacttttcttatttggggaattctagagagtgtccttgtggtccatcattgatccggtttggagggaaagcaaaagagtattcaccaagggcacgaattcgttcctggatggggtgagtgtcagcgcagaagtgttgtttcaccatcctcaggtcagggtcaactttctcttcacaccaaaaccagtctaagaattgcagtgccatcttgcaaaacttaatgcatattcaactgtagatgtctttctctccctgaggtttgcccattaatgggcagatttattagggtgtagtagattgcttcctatatatcatagggttgaatggagttattgtcaatgttcttggatctgccctcttactcttcccgtgatctgtgtctttgggtttatgcacttagccatcctccctttcttttctagcatacttgagattttttgctcacacctgcatctctgcagtatctcagctgacctccctggcttaggtctcttccccattggccttattcctttgtagacagatgagctgtcatctgatacggacttatcacagttcttcagtgccatcttcccttagtgctgttcactgtgtaattcttcaagtctgacttccccagttaggtgtttgggagcaggtgtttgcatgtgcttcttgagttttctcatggcttaaaccgggactgaatgtattgcaagcattttaacactcagtggcatgtttttattccaggtatgagttgccttttgataggcacgattggatcataaaccgttgcgggacagaagttagatatgtgattgattattatgatggtggtgaagtcaacaaggactaccagttcaccatcctggacgtccgtcctgccttagattcactttcggcagtatgggacagaatgaaagtcgcttggtggcgttggacctcgtaaagcactgtttcagatggaaaaatataaactatttttttctgagcgatacattaaactattttccccagattgaattgcactcatgatgtaatgggaacttcaagtgggtaatcacactttttccttcacttaacgaaggatactatgcactgttcacttttgacttgtgttgtaccttgcagtttatagcagatcattttgttttcttcctacttagcttaagtgggaagcagtctctcagtttttcctttacctgcagtattgtctgtatatttcatctcgaaaagcctgaacaacctctgaaaaagagcttttaaaaagtgatgaaagttgcttttttttcttactattttctcaggaatactccagagatgtaaagcctgagagtccatggtgatgctcaagagctttcatctggccaaatattttaactaaagctgttcattataaataagaggtgattataccttttttaaaaaaagttaccattatttctaaagcccctatggtatgattgtgacctttaacaaaatgcaaaggtatacactggaaaggtactcagcaaaattctctccaaattctgatttatatgaatttcttggactggatagagtactttcaactataccttcctttggaacataccttttaaaaaatgttccctttaaatcctgttattctaatatgtaactctgctcccaacaaacaggtctcctcattgtccttggcatttgacaagttatcccaacttcgaatctcatttcttcctttgctggcagcctccacccttccccacatcagtcggcctaatccaaaccttgaaagcctggcttaagtcccagtatcagtgatggtccccctctaaaacatgattttatatttggctgagtgttaaaattcacaagatgagcatttttttcccagatggagaacgcttcaactcagtctagattttttttgtttgttttaaggaagctctaagtttgccattgaaactttttgtaccagtaatccataaactggttgttctatttatagcagcatgttacaaatgactgctttttttttttaactgtctatactattaaatcctttaatttatcctgaatgctgtagtgttaaattagtggatgaaattggcagtctgtgggtgattaatttggtatggatttgtcagttttgtgtggagtttaagaaatagaacagccttaaactctacatttcaaaatacttgtatattttaaaataaagctgattagttcacaggttttgaaaattttttggaataattttacacttaacgattgtttcttcagacgtattatctttataaaaccaatgctttatgatagaatgatttataacccagcacacatatgtttattgcagcactgttcacaatagcaaagacttggaaccaacccaaatgcccatcaatgatagactagataaagaaaatgtggcacatatatactacagaatactatgcagccacaaaaaaggatgagttcatgtcctttgcagggacatggatgaagctggaaactataattctcagcaaactatcacaagaacagaaaaccaaacaccgcatgttctcaagagtgggggttgaacaatgagaatacatggacacagggaagggaacatcactggggcccgtctcggggccgggggggggtggggggggttggggggggtggggaggaggctagtggagggatagcattaggagaaatacctaatatagatgacgggttgatggctgcagcaaaccagcatggcatgtgtatacctatgtaacaaaagtgcacgttctgcatatgtaccccagaacttaaagtataataatttttttttaaaaaaaacaatgctatagtctccctactccaagcagccactttttcatctactaatcttttttttttttttgaaatgggagtcacgctctgtcacccagactgaagttcagtggcacaatctcagctcactgcaacctccacctcccgagttcaagcgattctcctgcctcagcctcccgagtagctgggattacaggtgcatgccaccacgcctggctaatttttgtatttttagtagagacggggcttcaccatgttggtcaggctggtcttgaacgcctgacctcatgatccacccgccttgacctcccaaagtgctgggattacaggcgtgagccaccgcacccagccctaatcacatatttttaaactgtagaggaaaataattactgttggcattttttgggggggtcttaagtgctatcgaatgagtgtgggataagacattcttatgaaagacaaaacactaactggaaacaaaaaatatgccaaaggcaggattcacctgttttataggactgtggtaaacaagctttaaactcaagcaaacttgatgacaagatcaagttttatacatcgttttactacttccagaaaaaaccatggcttcctggattgtcagagctgctttgtgtctagattatgcttgattgggtccaggggtcaatactgataggagttttcgtgtacagcttgaaactcatttaggatattctctggagttttaaactaagtcttgtgtctgtggaaatagcactattcagaatcagaacaaattactgaacatcaggctaagtattggcagacaagctggggctacaaatggattgcatattaacatttagtattcctgtcagtcactggctaacaaaatgtttatgtcccctttgtgcatcgtataaggaatacaaaattgcaaaaggtataaccctgatatggtttggctgtggccccacccaaatctcaccttgaattttaataatccccacgtgtcaagggcagggcaaggtggagataattaaatcatgggggcagtttcccctatactgttctcctggtagtgaataagtctcaggagatctgatggttctttaaatgggagttccccgcacaacttcttttgcctgctgccacgtaagacatccctttgctcttccttcgcctttcaccatgattgtgaggcctccccagccatgtggaactgtgagtccattaagcttctttcctttataaattacccagtcttgggcatgtccttattagcagcatgggaacagactaatacccctacttgcagggaactcaacaatcttatggacagtctataaatgaaatggtggtaaatgctagaactccaatttaaggaacacattgtggtaacacacagtgtgagaattcacgtaagtatttttgaatatttagagatagttaccaatttctttactgagtcatcattatggtttatcttctcccagagattgcttcttagggaaaatgaagcaatgcacatttcctgtctcacctttgcagtgactgtcagaattgtatgacccgtcatttgtgtcaccataggcttgaggctgtgtgtgtgatgattacaaatgtgtgtcctggaggcagagtccttgccctgccctttagtcgctgtgtgatcttaatgtctctgggcctcagctttctcggctatgaaatgagagtaatagaaccaacttatcagagttgttttgcaggtactttgaggtgatgcctaaaagcgctgggaacagagtctgtgggtggaaatgttcagcaaatattagctatcaccattgatcaacaacagcaaggagagaaatcaaagtgctgagatataatctacttctctcatcctctggccttattccccgccccactccgccaccaggagaatcagtttagaggggtaacagcaggctctaatccccattttgatcaattttaaggattaccaggtgtttgggtgcttgctctaagaaagctcatgttatttaaaatcatcaaatggaaaaagaacaggttacagcctttgatctttcaaaaaatatcagggtaacaaattaggtacttgatatgcaagtcccacttgacaaaaagaaatattatattaagacagatacccaagctggagtgcactggcatgatctcggctcaatgcaacctctacctcctgggttcaagtgattcttgtgcctcagcctcctgagaagctgggattacaggtgcctaccaccacactcagcgaatttttttgtatttttagtagagatggggtttcaccatgttggtcaggctggtcttgaacttctgacctcaagtgatccacccacctcggcctcccaaagtgctgcgattcttgtgcttcttaatctaaaatatagctcactgtaatgtcctttgggtcacaaggttatccccctctgtgaaaatatattacatatccggattcaaaacatattacaaggttgtttactgcaaagaaaaagatcaaaaattatttcaaaagccatgtatattccttgtaacttaaggtaacatttaaaaaattatataatttggggggtatatagtatatcaaaatgaagcatatgaattatgccttgcgccactcatgacaaataatatcacgttttcatttataagtgggagctaaatgataagaacacagaggggaacagcacacactggggcctattggagggtggagggtgggaggagggagtggcttaggaaaaacagctaatgggtactaggcttcatacctgggtgacaaaataatctgtacaacaaacccccatgacacaagtttacctatgtaacaagtgtgcacatgtgcctctgaactttaaaaagaaaaacatttactgctgcagtagagattgtcactgtaccttcagtaaaatttcatgccattggtgtaagtggtaaagtgtctatttcatgcttgtgcactctctagtttggaagaaaaagctgacaacactttctgcaaatgattcaaccggaggtttatacatcacattgcaagtattctaatgtttttgtggaatcataccagatgcaggagcaaacatagttcctaagactggtttagggaatgaggcatgtacatatgggtgctatcttgtatttataattagcttttcattgatgcttttacacaccaaaggtcatatgtgataggggcacagaaataatacatcttgagtgttgtaacagaggaattgtgagacaagtcttcacaatcatagacgagtgaagtcctaaagaacaatgaaaagttactattttgaaagttactattttggagctctgtgcagaatcatcatttaaacactttgctattccttctacatttgggataacaatgtgactaattcccgtgccccttcaatggtttgctatagaatattatcaggatgcttttggcttctagtaagtgaatccctgcttgaactcacagccagaagtgcagaggttgggtgtacacttggttgatcctgcttctctggactccctttccttccatgttcaattttaacttcatccatgtagggctggttcctttcatcagcgtcaatgcttcctagttgctttgagatccttgtttatggtcagtagatatgaggtggggtgggacccggccatctaccacaaccatgggaaataaggtttctcttcagtctaattgggccaattcagcactgggcctgtgtcctaccacccctcccattttatgttcctgtgcgtgcttcatgcttagattagctcagacaaatcatcaggaggacatgtagtgaccacaagaggattccttcactgctgatttaaaatcccattcttagacatcatttcattaaggtctttttccttcatctgaacctttttaaaaatttttttctgagacagagcctcactgtagtgcccagtctggagtgcagtggtgcgatcttgactcactgcagcctctacctcccaggttcaagtgatcttcccatctcagcctacttagtagctgggaccacaggcacatgccaccacgcccagctaatttttgtattttttgtagagacagcatttcaccatgttgcccaggctggtcttgaactcctgaactcaagtgatctgcctgcctcagcttcccaaagtgctgagattataggcttaggccaccaagcccagcctgagcccttttcttatgccagggttttaaatctggaggtggtagctaacgtaatggcataaaacaagatttgagagctttgtttctgcactgattccctgtgttaagctgggagatttgggacaagccaccttaggcctgtaagtctcaatttcctgaaattatcttaaaggctcctttcataccaaaatgtttgtggcctcatattacaatgggctgaattatgtcatctttcaggttgagaatctttaagttaagggaaaacaatgtggtttgaaaccctatttcaaactagtttttatataaactacatcagtagacacactcttaaaagacctacacttaagcgaattccaagttaaccagtgctttcctttccctctataaaatgtgctggcttggaaacaattcaaacattcaccaattagtaaatggataaatacatgttggtatatccatgcaatggaatattattcacccataaaaataaatgaagtactgataaatgctacaatatggatgaaccctaaaaacattgtgctcaaagaggccagaaacaaaaggccactttcgtatgattccatttatttgaaaccctcagaataggcaaatttataggggcagaaagcagattcgtggttgtcagggctggtggaggaggaatggggagtgactgctaatggacgtgggagtttcttttgggggtgattaaaaaatgctctaaaattgatggttgcacaactctgtgactatactagaaaccattgaactgtatactttaaatgagtgaattgtgtggtttgtaattatagctgtttttaaaaatgaaaaagaaatagccgggcgcggtggctcatgcctgtaatcccagcactttgggaggctgagacgggcggatcacgaggtcaggagatcgagaccatcctggctaacacggtgaaaccccgtctctactaaaaatacaaaaattagccaggcatgttggcgtgcgcctgtagtcccagctacacgggaggctgaggcaggagaatggtgtgaacccgggaggcggagcttgcagtgagtcgagatcgcgccactgcactccagcctgggcgacagagcgaaactccgtctcaaaaaaaaaaaaaaaaaaaaaaagaaataaaaacgtgctggttgatccctacagccaggaggtccccatcctcctagttgagcagccggcttagcatgagccagtaacgtaattattttaattaaccaaaacaacagacaatgcaatgtaaatgcataagccaagtatataaagactaatgaatgataaggaaggctttgaaggagaatcccaaaaaatgttgccatgaaactggaaggggtttagaaaatatcataaaaatcagaataatttttcactcactgctttgtagtcgtttcttaaatttgctgttaaaaaaaaaaaaagccctggaactggaagaatagatgatgcacagtggatgtggttcatccactgtgcattagtaagaaggatgaagtggcactgctgacccaccgcacccagagatgcaaaaggccttggctccttgttgaaagattagtaaatgatgtacatttatgctttcaggtaaaatgtaacatgtgatcattttatgatttctagtttcagctggatttttttaaaagtatgatttgacattgttcaggccaagcattgccttagaacagcattttggatcttgctgcctttccccttccacctctctcccttttgtggtttccccagcaagatgcttttcaagcttttgtgtactatgtatcagaatcccctagagggcttgttaaaacgcagatggctgggcccccacccagaattcctgatcctgtatgcctggggcggctgagaattcttgtttctaacgagctcccaggagatgctgatgctgctgggccagggggcccaatttgagcttcactttcctctggcatcttttgaatcctttgagcttccatccacccccatctttgtgatgcatttacagttgcctcatagtcacatagccgtgggtcgaagttcccatgcagaagatgcaaaagcaaatcttaaatgtaaatgccacttccccaattttgcttattttccatttcttctttaagtcctcctgctcccctcacttctgaatgttgcctgattacacctttgttttgctttaataatgaaaagctttcctctgaaagttcatttcttcatatgacttctgtaggtgatgatagtgggggcaggaagataatggggtgaagacaacagcctcccagactgggtaacagaaggtccctcttagtgtacgctgcttctatgagaattgttgtctcaaaaggaaaacgctttcttggtagcactcactggagaaggaaaggtgctctgggtgattcctgctacttgacctttgctcaacacattagtttgctgtggctgccataacaaagggccataaatgtagtggcataagcaacagaaatttattctctcacagttcttgaggacagaagtccaagatcaaggtgtcagcagggacatgctccctctgaaggctctagggaaggatctgttccaggcctttctcccagcttctgggatttctttcacatcgggcagcataactccagtcttcatatggtgttttctgcatgcacgtgtgtgtgtgtgtgtgtctgtgtctgtgtgtgtctgtgtctgtgccccaacatccccttgatttttaggacaccagccatattggattagggcccaccctaatgacctcatcttaacttgatcatctgcaaagactcaatttccaaataagatcacattcacaagtactgggggctaggacttccacatttttgaggggaacacaattcaacacttaacactcacattttcagaatgactgtgaagaaattcatccagggtcaggccagctcatttatctggtacctgtcactgctgaattgctccacttgtgctcacttgcacactttgctgggccatgacattgcaaaccagtgtggtttggcccctgtattggcaaaagggtgaacccagaaggcttcacccttttgcgaagctcaatgtgctcctggcccttccacagactgcatgagcagctcatgcatgcctctgatggaagtctcttggtgagagaagagggggagggcaagataattgtctgatcccctgcaaagcatcaggaatgaaaaagagccaagtggctcatctgtcccaatgttcctttcatgattgactttccccagcagatcctgggcccagacccttggtgtctgaccaagtaaagggatatgactagaagaagacactgaacactgaccctctatgtttctttcctgcagaaaaaagcctgtttctaatcccttctctaattcatttaccttctaaggaaatgaagtcatctcctttgtgcagaaacaagaaacagctttggccttcccctactggacatttgagggttctgttctccttttcattcattgcccaacattacatttgatcttggaactaagcaaatggcttagtctgttggggctgctataacaaaacaccataaactgggaggctcataagcaacagaaatgtgtttctcacatttctggagcctggaagtccaaggtcaaagcactgacagatttggtgcctggtgagggcttcccgcttcatagacggtgccttctcactgagtcctcacatggcagaaggggcgaaggagctggagcctcttttgaagagcattaatcccattcatgagggctctactctcatgacctcatcacctcccagagttcccacgtcctaataccatcaccttccgggttaagtttcaatatatggattttgaggggacaccaacattcagactctagcagtaagagaagcacacactaaaagataatgccagagaaacagtgactcagacataagaatacaaaaaaatatgatggcagaaatagaaacacaggaagaaaagtatggaaggaaataagtggaacaggttttgcatatcataaacattgctcatactccctgggatggagcaaggtacagttttaccttattttacattttggaattatgttccgatggaaaagagctctgtggaggagttaggaacttcgtaaaatggcctcaggcaaaaggccctttaacctccttgggcctcaggtggctcacctgtactatgaggggcttcctgttctgaaactgggtccttctctttatctagcaaagaacgtgaccagatctgcctacatcatttgcaagttccagtggaaaatgaaaatgtggggctgcttgttcaaaagtatgaaaattccaagatggcactgacagagtattcaaataggtgctgggctcttccaagcatggggtcctctgtgactgcaaaggaaaccaaccctaattgtgaccacaccatccctgatttctgccaagttctttctaaggtgtttgctccacttccagagactgtctttcctgtttggggtttaacttcaaaatccaagcagcattttgtgctatggtcatttctctgacttttcaccctgggacagacagaatgatggatggatggatggttggttggttggatggatggattgattgattgattgatttatctattgataaatttatgcaacgatttatggtttgcctaccagacaccagacactggcacatttgctggatttgtgggacttgacagcatctgctgcccttcttgcagtacagtttacaagagtgaccattttattagctgagatatctttgaaggcagatttggacttgtcttatctgtctttctaatgggcttggaagccagtaggccactggtaaatattgactagataagttattggatgaatccatcaaccaaccaattgacctaataaagccattgcatggctattatagctgtatgagccaaaggaaaatctaaagataatgctaaactaattaagtgcaaggtgtcaaattaataaatacgcaaattgaatattcttaagtataattcaaccaggagagttcaatgactaaatcacacccatttttccctgtggttttgctatccaaaacttttcaaaaataaaaccctctttagacctttttaaatttcagctttaatttcccttacttcagtaggaaatgggcagggaacccagagcccttcaatgctcccctgaagctgtggatcatcccggaggcaggagccctccccaggggatggtccagctaagccctcttctttatgagagatacccaggggctccaataaataaccacagagctttgttcatagactctgcattatacaaacagcaggtggcacagttggatggcctgtgaccaaatcctggttctgcaccttctagatgtatggctttgggcaactcatttaatgtcactttgagccaattgtgccctctggaaaatgagggggttaaatgagtgaaagtgcacaaaacactgagactagagcagaagttgttaataaatgttagttactactactgcatttcaccacaagcttcccaatttttgtttctaaaatggtctcacataggacaccaattacactgccatttgtcgaatatttgttatgtggctagcactgctctacgtattgtttcatataatcctcagaagaatcctggcagtttggtgtttttatgctccaactattctgataaaatggagagtctgcagattaaagcaactttcttgaggtcacccagctgataaatgggaaagacagcaatcaaaccttgttctcttggatgctgaggcccatatcttgaaacatccttgtctttttgatcactaagtatctattgcatgcttaccagggagcatagaactatacatttacttatgtcatttaccattcaaattttcatcttaagaatggaaagccacccacttcctctgtcccatacagtacagagctgaggtggtacatctctgcagaggagggctggttgagagaccatgtctctgtgcttgccatcagcgtctcctcagactgtctccttctttcttcaaaaatctatttttatttggaaaatatatcactatctctgcatttgccacgtggatcattggatgaatctaccaatattggattaatacaagttgacagacatgtatttttcctctactccatggtaagctgcttggtcatatttacacgcatacattcagcaaaattttatcaaatgccaactgtgtgtcaggtaccccagttctgagggtgcagaaaagaaatacatggtccccaccctcagggacagagaggaaacaacgtccatataaaagaataagacagtaactgtaatgcacagcaatgcttgctcacactgccacatggcaaagggccagaataagctgtgtagaatcatgtttgtaggaagggaaggtttgagctgattttgccgggaaaatagcttccaattgtgtaggaaaagcagggaagagcattcgatacccttggaacaaaaatgcaaaagtgtgctctgcacatgggaatgaggttttctgtacatggccagagtatggggtgccatgcttgggagagataagaggcagaggtagatgagaccagatcgcggagtatgttgatgttatggtggggtatggactttgtcctgtatatctgggagcaggagggcatcaatggtttttcagcagtgatgggcctctgacataatgtgcgcttcagaactataaactgtggcagtatggaggaggggtgggaggccagagatggaagggcccactctgagtggggtggacaaacagtaaacatgtgcacagtagggcaacaagagggggatcgcaggccaggctgctggtggggagcaggaagcggtgctctgcataaagataggagtggtggctggtgagaacatggcttactggtccttcaggatggttgaggcatccaggggacattcagcgagaatgtcaaacagatcactggggaatgggtggggtattaaggttggagattagggttgccagatttagcaaataggtgctaggttcaacttgaatgtcagataaacaacgaatccctttttaatgtatgtcccatgcaatatgtgtgataaagaataatttttttagcataattatgtctcaggtattgaatgggaacactgttactaatacaagatcagttgtttatctgacattcaaattgaactgggtgtcctgtatcttatttggctaccctacttgagagatgccaaggtcaagtgtcctggatcccccatgccacctttccccaccctgccgagtcatagaatggcctgtgtcccagatatgggacttttttgttttttcctaaactcggaacattcctggggaaactgggatgagttggtcaccctaagctgaaaagatattggttgaattgaacttagagatgcttctagtcctttggcgacctcttgggggcctccagttggagctgacactggatgtaccttggtgaattgagggtcacaccaggtcggggtgggtaccccagaaaccatggtctgccgtttgccatctccatgacaccatctgtcaccttgactgtgccgaagaagaattccaacctttgtccaaattttcccttggtttgtttttttttttttttctcttgaagaacatttgctactgatttagttctgttttaaaattctcagttgagatgtcctgttttaacctctgtgtaactcttcttcagtcatttcctttcttctcagttcagtataatctacctcccccagtttgcttatcagaccaacataccccacaggcctggactttgttctgacgtccctttatatttaatcccaatgctgtttctctgccaagcagatgtgtattaaaatgtgcataagaaaagaagcaagctgggtttatttagaaatttcctcaatttgcacaaattccattggtataagagggtttttttttctataaaaacccacaacaaacatatggtaatagctacttagatggatcaagacaaattcgtatttggccatttctgccatccccattctggcccctttgccagagacacaaaaacaatggctcatattgtttcaatgtcaatgtcagagtattcatagatggagaaacatatgtgacacactgaagcttttttcatgcttgttgaagctgtctgttcatggggaatgagtgacttgaacagccttttaaaggcattttggccagcttgaaagagttttttatttttttcttgtcaggtattatatcatttataaggtattagaaaggataatttccctcaggtctttgggtttcatgtacgattttttttaaactgcttattttcaatatgataaaggcatttaagaaacaaggcccggcacggtggctcacacctgtaatcccaacactttgggaggccgaggcgggtggatcacctcaggtcaggagttcgagaccagcccagccaacatggggaaaccctatctctactaaaatacaaaaattagccgggcatggtgttgtgcgcctgtaatcccagctactcaggaggctgaggcaggagaatcgcttaagcccaggaggcagaagttgcagtgagcacagatcatagcactacactccagcctgggtgagagagcaagactccatctcaaaagagaaaaagaaacaagctgtaactcactaagctaaagacatggcccctaagcttaaatgtacaaagagagggagagtgaatattgagatatatgtaaaagatattgtgagtcctgttttctggactgcttattttagatctattaacagatggacatacttttcgtgaccttttctgacacaggcatcaacttcagggccatttgatctggatgtttttttaaaaataggactactctagcaagaacatggtagaaagagagtcgcatttatcaggccatccaatctaggaaggagggaaagaactgatcagatcatggtcaaattcaaagccagggaagtagcatcagcaggagtaggatgagagtaggtggcacagaaaagccacctgcgatccacaaccaagcagcatttcctctggatcttgttgacaacttttggctgagtgtgggcagtcaggaagaaccagaggtctgcaggcaaatcctccctgagtcccagccagtggtggaagtgctggaccggatggcagagcctgaagctatctcaaaccattcccaaataagaaataccacatgccacttctagcttttattatttcggccctgaagcaaattaggcatctaaggcccacagagcaggtgtagcttaacaggaattgcgttgggcaacagctgcccaacacagttcaggaaactcaggaaacctgagtttcagtcctgtagaaaaccacctcttcaacagtcgaggaaatcagcctttacttgcaacaaattattatacatttctaaatgctttggtgtcactgagttgatgtcccaaagccatctgatatttttaaaccagcttttttgctatatatgtatatgcatagaattgccatgatttattacacttggatctgtggatagtgaagaatatgtctgaaatgtgatgcaaattcattcaagagatttaaagccaggaaacaaagcctttgcttaactttttattcatcatggcacaagatagaaccttaagaaacaccactgggaatttcatcaccaacatgaaaattaagagtagcatgttttataaaaaaaaaaaaaatctttttttataatacactttcccttcagaagtgaaaaaaaattgcataaaatactgaagcgtatcgccatctgctggtcaaaaatagttatgcacttgaaaaacttcaaactactaaagtacggtagaacattttacaatacacataaaattacgaaagaaaacatttcctcagcctttggcacaatgtaagtacaaagctgtaggccttttaccaaatgtgatttagtttttaaggaattgcatgtaatttggcaaatactgattatggggcaaagggaaaaaacatgttctataatttgaatattctgtgtagattcttaaacactttatagttggattccagtttgtagttttgaaaaatacataaaaattatacattataaatatatattatatatggcctatataaaactgaatttgatgtaacgtgggacggacaacttcttaatttctttgtgaggcactgcctttttcttgtttggttaactgaatcctttctaaacaagttctaaaaatatatttcgtaatctatcagatttagcattttcctgaaaacgtattcaatatctaaaagcattcagtgatttttctttttgtatctgactcctatgtaaaaatatggcttctcatattctgcttcctcttgttagtgtttggtatcgaaggaagggttatccccagttataaagctatggcaaaagcacagaaacccgcttgtgcacattctagaacattctatagaatctcattgtttagtatatctcattgcttaatataagtgaagtgattttttttttaaaagttccttttgttttctctttgtgaatatatcatatatgattatacataatctgttacagaatacacaatagtcaaaaccgaagacacataaatacggttaggctataccaagcaagagttgtatcttatattatagagccaagagggacgtttttagattggacattgccatctggtttgggttctgtttgtttttcctaaggctggctacgcaatggaaccttattctcaatggcgggggcgtgagtgctctacctctgtaggtgaactggatttctcttgtgtcacttttgagaagtgtgaaagaagaacactaagtgtgccagtggccaccacccacggtcccccctgggctggagggcggggggctcggggcagggggggctcggctgggtgcgggctcagaccagcgtctcgggcagggcatcggggttgtcggtcgacaggagctcccagatctgccagcgctctctctgccagtcgagccagccagcgtcccccaggcgcggactgtcctgctcgcccgctggcagggagttggcgctgctcagttttttctgcgtgacctgctgctctcgctcggctgcttggcctccctggtccgtgggtgtctccacgccttccgggggcccctggatccaggctgccgctgccgcgggcttccctgggcccgggtatggaggcgggggccgcttgtcatccctcccactcccatggggtctttggcactgaggtgtggcccggctctgcagcccggccacatccagctcactctcgctgaggtcgtgggcgccgctcagggtcaagtactgctccgacctggccgtgggccgctcggctttccctgccacctggacgtggggcgtgctgcaggcgcgcgacaccgcagggtgggccctgccctccgtcgcgggggctgcggcctgagtcctccgagccccctgcgtgtcgctgtccagctctgcggggctcccctgccaccgaggccaatttggggacaggttcccttgagaaagggagcagggccccgctcttagggagctgctttcaaaaatgtctccagaggaacctggaagccagagagaaagcccaagaaatggaatcagtttgtagaatccttgctggggattcaaatcctgttatttccttcccacttctacgacgtccccccggacttctaaaactgaaacagcacagtatgctcttagctgctgctacctgaagaaaacaaccttcccagcaaaacaaaaaaagacaaatgctttttgattatcggctcaattcatatgcctagactctgacaggttagctgagacgtcagactatattaataattggctttgccaccaatttgtgtttcaggaaagggcccctctacatggctgggaaaacttttcagaatccagaaggtgaaagaagcattcccttcttgttcaatgcaatctgtaatccaggagagatacaaattataatgttttcatgtttctattgcatcaatgaagttacttgaatctcaagtaccccattccatgccagaaggcaggccagccactatgcatattctcctaccatcaatgcaggaaaggctgacttggtgatcacccaatcgttcccctttacttcctacatggcagtttccagcctctctggcagttaggagggccacagaaatgaggtctgggcaacaaatgtggacagatgtgatgtaagccatttctaggcctgaactaaaaaaaaaaataaaaaaaaaaattaaaccaccctggctaacacagtgaaaccccgtctccactaaaaatacaaaaaattagccaggtgtggtggtgggtgcctgtagtcccagctacttgggaggctaaggcaggaaaatggcatgaacccgggaggcggagcttgcagtgagccgagatcgcgccactgcactccagcctgggtgacagagtgagactccgtcacaaaaaaaaaaaaaaaaattaaaaaaaaaaaactaaacgaatgccttcctactgatctttgctttcccccttcccttaactaccagcccagcatgaagactctctaggctctgaaactcttggaagactcccggggctctgaggatggtggagccactggatatgtggagcctaggctgggccccttagtgactatgtggaagacagcattccctcccctcacacactcccgcccctcctcacccctcacagtccacactgtactgggacagtgagggagaaatccagttgtaataggttaagccactgccccatttcggagttgttacagcagttagctttccctaaaggatacaactttctttaggaaactgaagggaaagaaataacagtgcattttgcaaggcaaaggaggagtccttggggcatgtgtacccagactaccattttcctatgaatctgctctgccctccacttcttaaaaagcagacaaggaacaagaacaaggccatgttggggacaggggagtgggggatgtgagtatttacaaagaaacaaatgatagctgaaacaggtgacagctgaaactggaaaaggaaaatggagtaaggctcttcacaggatacagtgagatatagttagaaaaggaatcagcactagagggcattacatttaaaaatgcactgtgcttttaaaatgtaatatgggagatattacaaaacaatgagaaagggaatataaatataaatataaaacaaccaaacaaataatttacacattttataccatatataacatgtattccagatggattaaaaaaattaaggttgaaacaatgaaatgacattaaaaagaaacgcatacagatgactgactatccaacgctgaactgaagattaattttatgaaagaattcacagagaagagacagtgataaaattaattatgtaaaaaaagaaaatgcaagtaagtaaacaatatggaaaaagagttaacatctttattatataaagagttcataagaatttaaaaaacactggcatacataaataggaaatgatataagtaacaattcaatggggggaagttcagcaaattaatagaaacactgaaaaatactggtaggaaagaaatgcaaatcaaattaacaaatgcaattttgttttttaagttagcaaaagtgaaaacccactaacttgcaatactgatgagatttgcacacagcagtgtaaaatctcctgccatccacagtttacagaatgtaaggtagtgggtcccatacagcacaggaggtgactgtacctccagattcttggaaagccttgttatatttgacgcacttccctgtttgggatttataacctttgacttgctttccaaaattttgtgaatctattaataatttgaaaaattaattacataaaagaggctcctgaaagtgtaacttattacaacaataacaaaaaatttcaaatgacttagtattggtttgtaagctatgattatgcactctgtggaatacccctggcccttaaaaaggataatggagagtaactggaaaatggaagttagaaaataatacaaagttgcacagacagagtgactgtaactatgaaaacctttgcaaaggaaatggaaaaaaatatagtcaaagattggcatatttgggtggaaagcctaaggatagtttcatcccctcccattttcagcatttcccaagtaatgtttgacaagcatgtaatataatgatagtaaagaaaactttagaaaataattttaaaagtaaatgcaataaagtttaaaattaatacttcacctgtcattcctgggtctttggatccgctttttaatgttgaatgccaagttccccagatatcgaaaggctcctctgacagatctagggaaaaagtgtataaaaaggtatataacacaaaaggaaaattaaaaatcaatgaacattttaataacatctcttctgtgcaaagtattgtattcaagatcctgttgtatacaaaacagaatacaattcagatccacctttcagcgtgttcattctacttgggatttacaaaaaggccctttctatatcatgctcgtggtagacagaataagggcccccccaaagatatctgtgtcataatcccacaaatctacaaagatgttattttcgaaaagggctttgcaggtgtgattaaattatggttcttgagatggggagattttcctggattatctggatggggccaatataattacaagggtccttataagagaggggtaggagagaagatgttgctagactgttggcttaaaagatggaggaaggggcctcgagccaaggaatgcagcagcttctagaagctagaaaaggcaagaaaacgattgtgccctaggacgtccagaagggaaagaggccctgtggacccattttagacttctcacctccagaaccataaaataataagtttgcatgttataggaaatgaatagaagggtgatgggtgacaacagctttataggtgctaaacacattaacacagaactagaggaacaatagagtttctgtactatcctcaggaatactttgctattggtatcactggatttcttcatgcatgcattcactcataaatccccttagcttatccatcaatatttatggagtaaggcactacattaggctttttcaccatctcatttaatcctcactacaatcccatgatgggattataattacgatttatagcagcagacgtctactgggtgcctccacgtgttcagcagttcacatgcgttatctcacttcatccctaggaggttcccagcagatcattttacagacgatgcaactagcgtaaggagcaggtaagaaatgcacacaagattacacagcaagtattatcgagtgcgtattacatttgaagtgctgcgttgagggctttacatggattagttcattaaactcaatgaattaaatactgttatcattctgagttttcacagcaggaggaaatgggactctgggaagctcaatcgctcactggagatcctgcaggttgaaagtggcagagcaggtttgtgactcccagtatagtgctctcttgtcattggatactaacactatttggttctggaaggttgtcttcatacatatagtaggttcagcttgttttctttagaaatgtaacagcagtaattgggtggcacctcagactagcaaatatgcaacccaaatccagtatacataaagttcctaggatgctggagggaaaaagaatcagctgggaataggagtggctcctctgggcatgcgtttatttcccagatatctgagacttggagtgtggcctgcagggaccctcccagccaacgactgggctcgccataccttcctcttcctagagtaggcgttcagcaggtactcggtaaatgcaggttgaattacagaaacatcaaataagggagagacgaagagaaggtccgaagagccccacaccatgccacatgcaacaagaggagggtcgcttgttttggccagcgcctgctggccaggctccagttacctttcccaagccttggtccaggagaactttcccttgactttgacgacgacaagtggcccaccagcataaactgccctggcactctgtaaagcttctccgagccccccggggccgcgtcctcttgcatagccagcagggagcgctcagacagcactggggagttgttgtcataaggggagatgtctccgctggaggccttgttggagtctgtagatgaatgcctccctcccacggaaaaggaaacttccgactgcagcatgtcagggcttctggcacaatgagacaattacaggtgcgtgagtttgttaacaagtagtgaccagatttaaacaatatggctattacacaaatgactggaggagtatgcgtggacacgggctgaaacaaaaagaccattttgagcaatgttccaagacatgtacatccatgacgtgaaagggtttcaacgatatgaccagcagagggcagtaaaacccaacagatataacaggaaaaggcaatgatggagaaggcacggtgagaatgaaaccgacaaggagccctgcatttgccaatgggcatcgctaagtgcctcagggactcattcctgcttccatttttaagtgaaagtctgatgctcactatctattaggtaaggatacactagtagataactctttcactttcctcaatatcctgcattaaaaataattcagataaaactatggttgacactttgcttgaagttcattatggctttctggacaacttttccatcccaccaaaatacttactgtacttagtgtaaataaatccatccttcatgtgataaagatgttgatgccaccggtgggaataagtgtttcatgtataaagtagtgacaaaaacaataaatatatgaccctcactagactccattttattcaaatacatctaaaatgattctacaaggcactagtgcttttacaaactgatatgatgtactaattagtataccattatcatagttctgtgttcatgagttgtcacagaaacagaaataacagtgaaaatgtatgtggaacagaaaaatgagaacttgagcaacgtgaaaagagcatgggaagtcttacctggaaacatctttcttttctaccctcctcaaaactggccctgacaacatcttgaagggaaacaatcacagattgattaaaagttccagaacctacatcttttcccccttacttcacttctctttactagtctttgctctcttttggcttaatttttcaaaacaaatcctttttatttcttaaagaaggtaaacacatgcctgaacaacactttcctaaccaaatggttttgtgcatgcaaactggaggaagtgcattcacagggatctagcttcctctgaggtttccagcaggggttaatatcgccgggaaaaacatcccagcttctgtgatactgccacagccgtaactgaggcaaacacgggcctgaacccttttgctgaggacatttcctaccaacatggaataaagaagccccttccttgcctcctctttgaactctcatcacgtaatcttatgggaaggagccagaggactgctatgaggatgattttccaggtctgcaagatctcattgagtggttgtgaagtgcatcccagggtggctgcatctgtctcacctgggaacttgttggcaatgccaattctacagctccattctggacctactgacaggactggctacaccatttgtggagcccagtgcaaaatgaacatgtgatgccccgtgtttaaaaagcgttaagcatttcaagatggccactgcaaatcagtaaaccaaatgtgggcttcttctgagtgtggagtcacagccctgaaagtcagctctgcctattaaaagggaaactcagggtggggccagcaaattttttaaagaatccctccaggtgattctgatgcacggggatgtttgggaacctctaataaccaaaccttattttcctctctcaatctgtagatgtgacagtgggctaaaggtctgctaagagccaaatcaggagggaaaccaaagatggtagccaaaactgcagcattggctgccctgggagtgaatgtggtggtcctgaccttggggtgactgaggccacagttaggagaaggaggaagggtgtccccatcccagccgattcctggacctcctctgtctgccttaagcaggatccagacaactgaatgtagtgtagtcccattgtggatcagaacattttgaagtgaaaggggggtaggaagtaccagtgtagtgttctctgctcttctggttcagtctcctaagtcaagccggcaaagtgaccacagctgggccctccatcagggaggaaacagtgggggtggctgaagcgaatccctggaggtagaggtagatgaggtgtctcatagtagacacaggctctgaacctccttgggatggctggggtcacagccagggacatagacagagggggcatccaatgagagacgatgtcttcttttcacagtttccccaccccccagtgtatcccagccatgggaggagatacagtgtgagtacacatggcaagcagtttgggaaatatacttatgtgaaatatccccttggcctgtgaggagagtaaaagttaatatttatacagagttaattatgtggcaggcactgtactaagctactgttaacaactctcctttttcctgacctgagtctgggattgagtgaaagaaacaaggagctgactgaatgctgaataccatgctctctagcagcagaggcagttagggttgggattcttctagaatttatttggtagatagtgttcaacattattacaaatcagtagtaaaatgctctttcttacttagagttaatagccttttaaaatgtttaaaatatttccctatcattttattgtcttagcagaggtcaggaagtggcagccaaatttgcctaagaacctatgtccaagaattatcttctcacatgaaagcacaccgattaaaaaaaaaagctgttttattcactcctcagaactctcataacaacataggcagttcatagattttttaaaaaaatagtgtcattctattgttttatatctgtcagaagcaaatccaggatcaacatatatacacatactcacatatacatacatacccaacacacacgcacatacatatacatattcagacataaacacatacatatacatgcatcaacatatgaacacatacatatacatgcatcaacatatgcacacatatacatattcataaacacatatacacacacacaaatatgacatagacatgtacacatatacacagacacatattacatatacacataaatgcaactatatacacatgcatatacacatacacccacttaggtgatacaattggaagtaaagacacagaacagagagagagtaggattgctgaatggaggctggagtccggagaaatttccagagacttggaagcagaattgtgagggcctttcagagcatgtctctcctgtaatgggggctgggcatccagtcattgtggataccttcattacacacctgtgcttcctgtgtctgtccattttccattttccacttctaaatctttctattctatcccagtttctgaaacatttctaagtttatggaagctattgtaaaagcagcttgtcaaatttataaatcaggtaaaatctataaagttctgtaagattttccatataaaaatcacaaatcaaaaaacaaattcttataatccagaaattctgcaagaagacagggtgtgaataaatccgggtgtagtgtagtggaaatgtggatggtaaaagtttataggaaaggaaatttctctgaccctgaaacctagagataaaagtgagaaaagaaagaaaaactacctttcaggctacaactgtcagagaagtggttgtctgccaggaccagggtgcctgatggtggctaaaacccatcattgtgagtcagctctgggagcttcttgagtgggcattaccttcctacaaaccagttccaattggcagcactctaatttctgaacactggtggagaaatgggcccaggaggggaggttttagtgattttccacaggacactcagtgtcaaatctagaaaaccataccatcttttggatatgtccgaaaaatgagataagcaaccacaatgttttctctcagatttgactctaggataatccaaccctaagaagatagttttgagttcagggtcccaaataaaggcattaaaatactcatgtatctatttacatgaaatttttactctgatcagtgattcactagatgaggaatagtctaaaagcacatagtgacatctctttgtatgtcttggagtttgatggattgaggttcagaatgttgggtgaatgagttgccagttgacataagttggcatccaaaagtgcctggtggcttctctttccagtctcagagcatcatggattgaggttgggtggacaggtcaccagtctacatgggtttgcctccatgcatggagggtttccccgttagacccccaaaccccaggaccatctacatacagcatgcatggccaatctcagctaaccagacaagcaagggatgggcatggagagcgagtcacattctcacccttagctggtccctccaggtcagggcgtaaacatgctggcagggtactgtgggcaggcctgcactgcagccggaagcacagaacttgttctggggacaaatggaaaactccggttcaatcaccggatggggcccgcccagcaccttgctgagctaccccagcaagaagaactgtggaggtttcaaatgtgtgttggcttcatccttggcttaatcatatgactgataagttccagtctgttggaactgaaagcattgtatcatccatcttggattatatcaatggtactgggaaaggaatccactgctggagcagctttggaatcatgaagaatgtgcacattaatcaccatcagttctacaaagcctccctttgacagattgctagggataaaggtaccccacttcaaagaggaactgacatggctctaaactctccactggatgatgaagctaacaccctgggcataagcctttggtgaaatttttcccctcatttttagtccttattaattccctcctaatgtctctggcaaatggagcacttatgacaggtgaagatcagacagtgttgttttcattatttacagagggcctgataaaaacatcttcaaattaacattctgcaaatttataaagaagctgtgaatcatagtgaaggtgtgaggaaggaaggggtaatgtgatacattctccctccatcttgaatgcctttccatagaaggcatatatgcacacattttagaatttttcattatggaattctctattccacataagctttttctaaaactatctggctggaaagactttcttgaatggagtatgtgtgttgggggaggggggcaggggcagttaatgcttcataatttccagggtattgaggccaacagctaccgccactcaataggactctttgctgttacattgtactggtaaagttagatttcttgtctgaaaatttcctgaaaccctttctgatatgaaaaatcctagtaaaagaaaaacagaaattataatctgtcacataacactccatgtttgtgaaaaaagatatttttaatgatgagctttgaaagattaaaagaaatgatctatgtgatatttggtaagttaaatgtgatacctttaaattagaagaaagcctaatgctcccccagaatgaagaaggcagatttgtcattcaataagatgaacatctagctaaacaatacaattatttttcagtactgaaattttattttttttcagactagtacagatcttcaaccatgctcttgatacactagtcaccagttttgctaatttttaaaattaattttagtttaattttttttccagtaaaaactttgtgaaggctactaatagaattaaccacaatgaaatttaaatatatatacctgagtttagttcatccatatctgccttctctccaaatgcagttaaatttgttctattttgatcttgtttccagagtatagaagggaagatactttacttagccttatttaattaatattctatttctggggagcccctgaggtttgatagaataagagcaaatctttatatgtttcctcaagcctatatttaaaaattacaagacctgttgctgaaactagttactgtgtcacagatgatctgagctctgctgagctctcctgagctctggatttatgggggattttcacattaatcatgcttagttctgcaaagcatcccttatgcggaacttaggggcccgagatgcctcaggcaaaagaaaactgtgtacctctatatacatggttttgtgtatatttttttttcccagaacatcaaagcagttgaaaaaattgaaaaattgaaaagaagatacattcgaacctataatatttatattaaatttaaatgttttatgtatgcccaaacagaatttccttattattttatttcaggttaatttagttagaacttatttaagattgtcacttggtcaagagaaactgtcaaacatagcaattctctcagttggaaccaagataaacaaagtagattttgaaaatcttgctttgggagctgaggcaggaagatcgcttgagcccaggcggttgaggctgcaatgaaccatggtcgtgccactgcactccagcctgggtgacagagcgagaccctgtctcaaaaaataaatatgacttatgagttgcttccatttaaggcagcagcacatattttaccttttgtttcaggttctatgactaagcatggctagtctttttaaaattttgatattttctttatcaaacatttttggcattagcttggatttttaaaaaatattacattgcaatataatcaattttgctgactgagttttctggcattcccttaaattctgtgtctaggcaagcgtctcacttgcctctcactaagtcccagtcctactgtgattcctttgttttgttgcaaatattcacattcaacatatcctgtcctgtttgattaacctcccattctcattccctatttcctcacatccttaaatcaaagggtaggggaactattttaagtacctttgaagaaaagagcatatataatgctagtaaacatacctgacaagtatatatttttaaaaatcaaagtcttgctttctttttttttttttttccccctagagacaaggtctcactctgttgcccaggttggagtgcagtggcctaatcttggctcactgcagccacaaaaccccgggctcaggtgatcctcctgcctcatcctcccgagtagctgggagtacaggcatgagccaccatgcccagataacttttaaatttttctttagtagagatggggtcttgctgtggtgaccaggctggtcacagactcctggtcttgcattcttagtcataaaaatctcttctaatccccctctggcatcccgttttggttgaagccaaatacttaagcagacaagcacgagaaaaaacaaggaattatcctttaactcctccaataccgatgttgcataaagaagtgaaaaacccaaatcaaaacaaaatattaagttcccaaatatcactaaatgtttgctctttcaaaacagaaattataatattttcttgttcttggttttacactcttttgaaacttgtttcttttcccctccaaataaaatcttgtgcagtttccacttggcctcacaggaatgtaaagctttgtttaggtatgtgaactggtggcagagaacagaagcttcaggaaaaaaaaatcaaagggttagaagcaaatatagtgtttgcttttagacacaatgctataacttaaagtgaacgggttctctcttgtgtcatattgcctggaaggttgctatctcatgaaaaccaaagtagaatctagtgatggccacgcctttggtaagtagttgtaaatgagcaaattggtgatgtttatgatataccagactatacactaagagcataattctgtatttaagttggtgctactttttatctctagtttacagatgaggaaactagagagagagatctatctatgtattaacagatattaactcttaactaatagaccgcatatataatagcaatagaaatggaattgaaacgtaggcaatctggctctggatctgaaatggtaaccagtctattaaactacacaagcatgtgttattgacagataactgactacacaaacatgtgttactgatggataattgacttgccaatgcagccagcaccatctggcagtttagggtactgtaatttactataatttagccttacagtaatctattgtcactgcttcttgacttaagcaccacccctcagcctgccatttaagggcttctaccttcactgctggccagcctctttattgtgaccccagctagccaacatatttactgttatgtccaggtcctggtgcaagctccccaaatatccaggcttgtttatatcctccacagtcttcaaagttcactgcaaatccttcctcttctcagaagctatctctgagacttcaaatcacacctcttttccttctccaaactccaagtggattcatggtctggagcattgattcccttcctttgtcaacacaaggatgcctttttaatgtcaaaaatcacccagctcaaactcccacatgatagtaaatttgtgatatccaacgtggtagatctaagctagaggttcttaaccctggttgctcattaaaatcatgcaagagactttaaacaaaaatccgaatgtccagattgcagcctatgaaaatgaaccagaatctctgaggggtggcccaggcatagttgttcttcaggctcccaggtgattccaaggggctggtgagtctgacagccagtgggccagcacctattgtttggcattctacccttggaggcctcctccaacaagtctgaaagctcctaaaagcaagaatatactttgatattttaagctttttaaactcaaagtgtggatcatggaccagtagtatcaggatcacttgggagcttgttagaaattcagattcatagactacctccccgagtcctactgattcagaaagagcattttaacaagatctggtgatacccatgcatagtaaagtttgagaagcatgagtgagtgagtttaaaacacaaaaagaccacctactttgggaggctgaggcggatggatcacaaggtcaggagttcgagaccagtctggccaacatagtgaaaccccgtctctactaaaaatacataaattagccaggtgtggtggcatgcacctgtaatctcagctacttgggaggctgaggcaggagaatcgtttgaacccgggaggtggggattgcagtgagccgagattgtgccactgtactccagcctgggtgacagagcgagactcgatctcaaaaaaaaaaaaaaaaaaaaaaaaaggcaactacagctagaggggtagcactctggagctcaagcctcaaaagaccactaaaagtaaacactcatttattaacatatgcatttttacttcatgacatcattctctgccttctgggctgttccttggcctgtacctagaggaacacaaacaaaaaccaaacactttcttctcctaagtaagtcttcccccagtgttttctgttcactgataatgctagtctctgacatacacagagctcctatgggctcattcttctttttattttattattattatactttaagttttagggtacatgtgcacaatgtgcaggtttgttacatatgcatgcatgtgccatgttggtgtgctgcacccattaactcgtcatttagcattaggtatatctcctaatgctattcctcccccctccccccatcccacaacagaccccggagtgtgatgttccccttcctgtgtccatgtgttctcattgttcaattcccacctatgagtgagaacatgcggtgtttggtgtttctgtccttgcgatagtttgctgagaatgatggtttccagcttcatccatgtccctacaaaggacatgaactcttcattttttatggctgcatagtattccatgatgtatatgtgccacattttcttaatccagtctatcgttgttggacatttgggttggttccaagtctttgctattttcttggaagccctgacactcacctaagatcttggtctagggtctgctcacctacactttaaaattctacttcttactcttacggatagggaacagaaggggctggacaattgtacagcttggaatgggcttaatatgtgtgcttcttccttttcctaatagaagagaaagaaaggttcgctttttaccacagcatttatatgcaaagagtgtatttgaaaaccatgtaaaaaaacttctatcaactgttctttaaagtatagtatttatctatctcataatgccacacaaaagcagaaatttggccaggcaaaaatcagtggttttcctcaaaagtgtgtgttttgtagctttcccacacagtaccaaccatatgttataagtgcagtttaaatgaggggctcataaatggaaatgccagcatgtctcttttctgtacaagggagggaaataaatgagtttatcaaaattatggtggtgcatgatctgctgaaaagaaaagccatttgttaatataaattaggacttataccttgatgagggttagaaatctaggaaaaatttaaatgtaagcctaattctctgatatgaaaagcaagaccataaaatactagctcatctatacaatttgaatataattttattcactcatggctcttggggcttgaatccaggccttactttcaacagaatttggtcctatttgaatcagaatttggcctgataatgaatggcccagacacagattttttaaagtagatctgaaaggataatccaattaaaaggtcttccctgctaagctggaaatggagtgaagctgaatttagctgtgctatcaacgtaatgacctgggaaagaaggaggttgaacaacatggaattccttttcaccaaatttttctaaataatataactttttaagtatctgcaataatcatgagtgaaaattaatttatcaagttcaacaccaatatacaggaataacttaacatgtgttactgtttataagacaccatcgattaagacatgccattattttatttatttgtttatttatttattattatgagacagagtctcactctgtcacccaggctggagtgcagtggtgcagtctcggctcactgcaacttccacctccccagttcaagcgattctcccatctcagcctcacgagtagctgggattacaggcacctgtcactacgcctggctaatttttgtatttttagtagagagggggtttagccatgttggccaggttggtctcgaactcctgacctcaggtgatctgcccgcctcggcatcccaaagtgctggggttacaggtacgggattacgttaggagcttatcattggttataagattagtctcaatttcagagatcataggtcatgggagaaacgtatcttagaattgctgaaatttagtaggttaaaagtataacaaaagtgataattttgtaagagcatagcaacaacttttcctgtcacaaatttattgtttggtgtcctggtgatgatactactcctggttaatgatgctatattatgcccttaactggttatgccaaatgctcagcatccccacaccctctgcctctgcagcaaagattggaagtaaccataaaatctgactaatgcaaaaactctgtgctcctcttttgggagcaaaaatggcagcaagccatagcctgcagcatggcttgcattttactaattgcaaacatgagtgcatgtagaaacccatgtgcatttttatcaaaataatactagctataaaaagtgggagagccaagaaggtgcacacctctaatttcaaatgggcacctaggcctcagctaaggtctgtcttgtggtttgataatgggttaatcccactggtaaagctgcacaagcaagatgcatccaggcgcagccttaagggcccctatgcacgcttatcagaattctagaagtagaatcattgacgtgtattatagtcccttgccagtaatttgtgctttttccctgtaaatgaagtcaaaaggaccctgagaggctagagaaagctgaaaataaaacagaaaaatcttgtaatgtggtttctaatttggtaagtggattgatgggacccgaagcattttctggttagatggactgatcagaattgccaaagagttgccaaaattccacttcaggtcaccctgcatgtacttatgtaaacctttccaatttctcagaaatggaaatagaaatctccaatgcggctttagaagatggaacactggaatactcacgatgattgggaagcctttcttctgagtaaatagtccacgacatcaggatcggtctctaacaggctgatcagcacttcgttctggagatctgggggaacctgaaggagccaaatgttgaggcataaataaaaccattccagaaacaggcaacatatggtcactgacaattttactgtagcacaaaacagagccctaaaagctgcaagacagcagaatgatttgctggttaaaaccaaacctacgccaacccatgcagctgctttaattcttaggaccaactggatgattaccaatagtcatattcaatccaaaatgtcacccctcatatgcctggagatacaactgaaccacttggatgcctttattgctcaggttagattttcttggttttgaataaggaaaatatcatggttcagagaaatagtgtccataatttattgcccaatgggggcactttctagagttcacatttataattatgccaaggcagcaggcagaaatgatgactgtattgggcagttctggaatatatgatcagtttattaagaaggcaggcccttgagccagactgcttgggtttgaatcttagccacgccagtcactagctgtgggacccttgacaacgtacatcgacaaggatcttcctagatctcagtttgctcacgtgtaaaatggggataacaacagtactcaccacgaagcattgctatggtgattaaatgacttattatatgttgagactttaaaacagtacttggtcaatggtaaatactcaaaaaattgctggctactacatttgcatatgtcactttattattcggtgcctgcctttactcctttcttgcacctggtccatcagtgatgaaaagtttctcactttgtaatttgttaggcatccagtagagttctatagatgagcatcatatatttctctaagcctaatccatccacagtacattagaagatggcctcacaaccctaagtcatctgtgtggaaatgttctataagagatgattgaacccagctctgacttgtggtttcttattccatagaagctgatagctcaaccaaaggaaactcaaaactattgagagaaaataaaatttcagtctgattctctcacacatgagctcagagagaagactttttaaaactgcagggttaagtcttctgaaaataagtggttggtggaagaatttgcttcttgcctcttgcagaactctacagttcttgagctctgagaatctggaaacaattttattaataaaaacagggatgagaaagcaaggaaatgtgttctgtctcttacaaatctgttcctcctactttatcgtgaaccttcattaatgacattgccaacttctaatcacgcaagctcaagatctcagaattgtactaaagcttctctgcatcctctctccattcagagccaggaggcctactagacttcatctctgttacttcttttctcccttttccattccaactgcagagactcaagttcaagccctcattagccttttgtagtggtcatctgttcatcattaaaagtctccatttccctcctcttataatagttataccccacgttccctctggtaaaccaactgctacccaagccttagctcaagggtgaagtgtgtatcgtagtcaaagtctattgagcattccattcccagatcatcatagttgcctgagcaatgggcatgtgactccatcagaggcaatgaaaaccctggaggttttccctgagacttctaagagaggatacagggcctgtatccatatgaggcctgatgattgcgctgacaattgagcaaacaataccaagaaatagagataaaagggatgtcttgatatcatctgagtcccgggacaagctatgtctgaagccatatttgcttgtggattgttcagctatgtgagccttcaaattacttaagctagtttgagttttgcattgcaaagaaaaatacgtacttgatgaacctttgatacaacagctttcaaatttgtctgctatttccttaacatgtgcagcacatttcttctctatgtggttgtcagaatgccatggtcaagacactcatttactggaaactctttttattcccatggctgaagccatccacttgcatactgtcctcaatctgtctttcccatcttctcccctagcagtcattccacacaagctctacttcagcaccactgtgcttctccctcaggtcttctcttccctcccttcctttcattcattgcataaatgttgagtgaatgcttcctgagtgccaggtattggatgctgggaattcagttacaaaccaaacagacaataatccttgtcttcatgaagctggtaacaaatatggaaagacgggcattaaacaaacatacaagaaaaacatagagaaacacaaggcaaagaagggcaatgagaaatgcttgggaagacgcagttttcaataggattgtcagtcccagagaagctgacattttagcagaaaactcaaactgatgaaggagttggagaaaatcattccaggtagaaggaaggaaaagaaagccaatgataaaggtcttgagtcaagagtgatgaggaggtctgtgaggctggaagagagtaggaaaggaggcgggtggtaggaaggggtcatagggccaggaccaggtgtcatggagtcttatgggtcataataaggacttctgcacttacttgcagtgggtggggatccactggagattttgaacagatgactaacatgaagcagcatcactctggctgctgagttgagagtagaatgcatggagccagagataaagcaaggagagcagagagggcctgctgatctacccagataagatgatgggtcctgaaccagggcagtgaggtgatgagaaatatttccacagtggacatagtgaggatagaggtaatagcattaatttattggatggagagagagagaagagagggagagggagaagaaaggatgacctcaatgcttggggcctaggcaactagaaagatggagttgctgttgactggtttggagaagctgcaggaggagaaggttgggggtcaagttttggagtgtggttttgatatgataatgtttagaggtttgcaagacatccaaatgaaggaggtatcttgtagatagttggcaataaggattcagagttcataggagaggtctgggttgaacatagacatttaagaggcacatatagatggtatttaaaaccctgtgaccagctgcagtggcctgggtatgaaaatggggagaagggaaagggcaggatatttaggtcaagggtgagattattctcttactgtataaattaaacagaaagacatcatttttactgtattttttccaaagatcatcacccaacagccatgtgctattataacagtttttaaaaacgtaacacctaaagggtgaaaatgagaggaaagagaactcatatttttttaatgaacagcagagcaaaaaataatataggacaaaaatgtatgtcccgatctcttttttagaagaaaattccataaacaaattaggaaaagtacttgcattttcatccagttagtttaatttaaaacttgctaggctttgacatgtaataaaaaatttcgtggctgggtgcggtggctcacgcctgtaatcctagcactttgggaggccgaggtgggcagatcacgaggtcaggagatcgagaccatcctggctaacatggtgaaaccccgtctctactaaaaatacaaaaaaaaaaaaaattagtcgggcgtggtggtgagcccctgtagtcccagctacttgggaggctgaggcagaagaatggcgtgaatccgggagacggagcttgcagtgagccgagatcatgccactgcactccagcctgggtgacagagcgagactctgtctcaaaaaaaaaaaaaaaatttcgctccaagcactaatccattcttggatttaattaaagaataaacagttagagtgcaagcccttcagagtggtgcaagcatgacaatattaattctttgagagtatgtagtatgtctaagataaattatcaacttggatgcattattagaataggtttcagaagtatcattacttaaaaaataactttccataaatttttgtcaagctagtctgcaattcagaggttttcctcattcaactaggcgagcaatcataattactgaggtctattttatgtagcatatgtgactcttacttggtaacaaatgcaaataggaagggtcacagttataaatctatctacagtttccttttaaaaggcccatggtaccattttggcttggagacactatttacaaatgcataaaaaagacatagtttaaaattgtagatccatgtattacaggaaggcaaataatattttcctatgtattatgcaaaactaactacagttgtatataattcattagtttatttataatccattttgttacagagtgatttaaggcagcttcaaaatgtatgtgattaaaccacattctaaaaaataaaggaatgattcagaaaattggagtcagtgggaaaatgaggtaaaaaatttgaaatgatgcctgaaactgattttttaatgttcatacaacagcacccagtactgttttcctataattcttctaatctttggctataactgcacatttcgtttcctaacatttaataaaaatttcaaactactggctcagttatattggatgaacacttatttctctattaatttaggtacttaatggagaaataaaagtcaagtaaataaactgataggaaacagcagcttgaaataagtaagaaagaaatatctaggtagaccactgacttaagcataccttttcaggaattaggatgctgtaaaaaaaaatctgactgaggcaacagcccctgaaatccagttttggctctgctgtttataattaatataaacttggacacatcaatcaccttctttaggattctgttcccacatctgaaaacatatgcatattcattttacttaatggggggtgttacgggaatcaaaagcgctaaaaaaaaatgaaaatagattaccaattgcaaagagatctagtaataaaatgttttattagaaatagatgaaataagtaagttaaacacttgaaaaaataaaagcagataacatggagatggacaatatttattctgcagttattagtttttattaacagtcatccattcgctttcagagaagaagcactctcttctcttttgcttaacacttcttttgggtaactcagttatgggattttctcttgctatgcctctgcttctaatccccctctgaatttctggagttacagcctatgacctcttggcccttcaactgcaatggtcttgaagtcagactctgtgtagcctcacccttccagttcctttggctagaccttgaatcttcccaccattcaagtcattagaaggtaaatttcctgaaggcagggattatctgatttgtttacccagaactgaaacaggctcagaaatttgtagttttctttcagctagcctccctcaaagctagggcaagatcacgtatgcacatgctggtacctgaagtggggcatgtaggagcttctggaaaaggttatcttccctattgaaaatgggtacatgaaaagaaacatcatctcttcattaattgatgcaatgatggctggaagagatgctgttatcaactgtagccattttgcagctgaagatggcagagcagagagagagagagcaaagtgctacccagctactgaaactgtgcccccccccccatatttactgtgtcacataataaatgctgatgtcgaaagccatttgcagttgattattgttctccttgccagtcaaatgtttcctaaatgatgtctcattttcctcctctaactttgccttcctactctttcctctctggaaggtcttacctgcacttctatgaccctcaccccgtcattcacttacacactctcttgctcaattttatgctctttcagaatacaagctagggtggtgatttctacccagtggatgtgcagtgaatgttgctgaaatggctaaaaataataataatctaaaatcacccaggattatggactgcatgtgttacgttgcccttgtctagatgtttctctctacttatcagtggtacctatgtcatgctgcagcacagtcttcttgctgttcatttctagagtgggaaaatacattttctttcccaactgattatcatcagattttttctaagttcttaagctatttttcttatcaatacaaaaacttcaaaactttttgaaaaagatagctcaataattaaacaacgttttcattttctgcttctgggatttttgtatatagcaaaatgggaactaaggagaagggtagtgaaagacatattacattttttaaaaaatcaagcaattctgcatgttaaaaagaagaaacgaaacccagcccaaagtgattcttcatttacaattcattgtttcacatcaaaatctctactgggctttagtcaaccttgtaacaattctagatattttctaagggtaccatttatggtcttgtttatctggagactcaactccttagattttaatgagttccttcaaagcataatgctgttccaaaaatcaaaagaactttggcccctcctgcttcagagaaaaaaatgtaaacactgcacatatgaaagaataaaactgtcacaattaaaatctacccgatcaaattaaaaatgaaaccttgaattattgcctggggtataactgctatgaggtagtttattccataaaccactgagagagaaaagtggtatgagttgagttttctccatttactaagtcaccacaataaaccattaagggctttttgaagagctattcccaggacccagccctactgcacttgtcactggatgttccacaccaatccaccactttgcacttgaccaagaaggatgctttagcatttaaaacccagcaaaagtaaatagcactggaaatcatgatggcattttgtagttaacaaacacactaaaagaaatcactttggctgtttatgggagcaaaagctcaaacaaggacaggcccagcttagaacctttggcgtggctctgttgtgacaggtggtttaataatttaaggggtctgggtgcacgggagggtcaagatgcattaaattcggcaaatatttctcaagtgcttgatacatgtcaggcagcatgttttggcaattcaggtacattagtgaacaaatacagtggaagggtccagggctcatggaacgatgttggaggataactcaagcaaagatgaaagaaatcagcagtctttgctccatggcaacaggttaaagggagtgggaaaggttcaggcataatttgcttctgcttccttccacctttgtgggacacaaacagtacacatgttctgtctttacagacagggccaagtgagcagactatagcagaacatttgctggctctggaagccatctgctggcctgaacatcaggggtgctatgattagtccagcagtattactgctgttaaaggtcttcattcctcatttccagattggctaaaacatattttcttgttctttccccacaaatggactccatatctgagataccacatcaaaatgcctcttcttttgtgtaaggaggcatcatgctgtagaaataattcatttagtcactgcatcacttgggcaaacaaacttggcttactcctcatgaaatggtagtgagatttaaacaagccaataatgtacgtaatgagtagcccaaccctggcacgtagacagtggtatttgtgatatatagaaaaggaaatggaaatcatatataattatgtggatatactgggaggggtggtttcttgcttgatgacctggatgaatgcttgactctttgacttggtgtgcaaagtggctttaagaaaatgcgattttcatcagggaatgaagagaacacaaagcaaagcttggcttctgactcggaatcctcatcacagcctctgacccttgctcccagtagtgctcatttgaaatttcccacgtgcactaagctggtccccagttcaggctgacaactcagtggggtgggaacacactggctttcccacgtctccactgcactccggacttttcatcagcttacaagggtggtgtcttctctttcttgcccctctcctaagaagaagtcctagtaagaatcgtttaatatcagcccttagaagaagctgacagttttctccattctgctctgaagttcttactaatcccaagagcaatgatgagttttctctggaattcccaatattagttacagaagtaacaactttcagaacaattcatgtatcaatgacttagtcagtgagaactttctggttaggataataccaatgactttgtgtagatattaatgattcttatccttgatttccagtgctcccacagagtatcattttatgttagccagtttttcaacaggtgttgatatcagaagtggagggtcatgatttaaaggtaagggaatataagcagtatggacactggacaaaatcgaaacaaaaatacattttttttctagtaatacagaattgcaatatttattcaacaaataattactgagcacccatcttttgccatatactttctaggtggtatgaatgtcagtgaacagaacaaacaaaaatctctgcctttataaggtttgtattctgttaggtttcaataagcataaaaataagtaaattatatagtgggttaaaaggtaataaatgctatggaataaaaagagcagagtaagggcctaggagtatatatgtgtgggatcaggtcacagcattatacacagtgggcagagtgggcttgatttccaagaaaacacccaaacacgctttgatagagcaggcaccttatccctttaatgtaataatagcagaaatcttcctttaatgcctaatatatgttaattctgttctaggtgccttaaaatgtcatttctaattcttataacagtcctgtaaattaggtcacattgtttcatcttttggctagggaagttaactgtggggcccaagattacatagcaaataagtggctgagcagggatttgaattttggtagctcattccaatgcacatggtctttctaccataccagtgtttcccaagatatggtttccaaaggtgtggttaggaaactaccagaactctgtggaggtcttcactagaaagtgcagattatttctgggccccatcccagtgctactcaatctgattctcgggagtgcatcctaggaatctgaatgtctaagtttccttgcaactctgctgcacactcaagtttgagaaccaccattataatctactgccttcgtattttgatatctgtggtcatgatatctgctattatgatctatttccagctcaaggatttccaaaccagtacctgaaaagcaaacaaccaatgcaaaagactgtcctagccagactcttaaattgtgtgtcaacctctgcatctaggttcctcttctgtattacaggacgaagccaggttcttttccgccctttcccattaactcagagagtggccacttgggagaggcagtctcagcatcaggaaatgaaggatgttagaacacccagaacaaattttgggtccctgccaggcctctgtgagcttctacatcccttccaccagttattttatggaatcactgcctccaggtctgttctgccttccaggacaagctcacagctacctttcctaacaagtcttcctttctaatgctaatagaagtgacacctccctttccgagctcttaaacccaaggactgtgaaactgcacaattactaactacttttaaccatcaggccctgactagcttcatccttctttgtttggaattataataattctgaaagcttctttaaaaagccaaacaaaacaaaacaacatagcgacatacaagattacatttttgtccacccatgcagatcagctttgctgacaaaccaccagccttggtatagccgactagtttctcaactgccaaatatgccaagataatctaaaatgtgatgagattaattttctcctgtgctttataaaaaggaaggaagggaagtcagtgctagggcatagcaccatgcagattttacaactagaaggggtcttggctatcattcattcaaatctagtatttgataactaaagaaatagaagaagatgaggtcatgtagccaatatataacagggacaggacgatagtaaattttctggttccagagtcagtttcttttcatagaccaagacttgagatatttgtctccctcttcctcccactccactgttatttttctgaatatatgattaccagaatccttctaaagaggtcaagaatgattacattaatggttaacttactccaagaaaggtatccttaatttctccatgcccaaatcttttcatacgtataaggagtaaggcttggtaatatggaaatcatatgtcacagaacaaccattgagtcattcattaattcaaccaatatttattgtgttcctaccatgtcccaggcacaggggtaatgcagtaaagaaagtactatagatagaaatggaccaaaaaaatcatcctgtcatgtagtttacatttctagggagtggcgaacataaacgagaaatttgtaagacccaatgttaacagtggtgagtgctaaggggaaaaagcagggaaaggaaatagggagtgatgatgtgtgtgtgtgtgtgatggagggtggaggtgcattttagacaaggtggccaggaaaggcctctatgagaagtaaagactataactggagaccaaaaatatgagagaatgccgacatcaatccctacagagaatggcaaacaaagatcagatttgggaaaagctggaaaaggtagaatactgatgtttttatactgttcttagtaattcaggtggcaggaaatggaaagaagagggatggcacaattaaaatggcagcagctatattttcaaagaagccaggaaaacttttgttggtatctgagttgaaaagaaatgctcgatgatatgtggtttcatataaaggagaactttgcttagataatagaattaagtttgatgagaagtattattttgttaaaaaaatccagagaacatgaagtaatgccaagactacttggcaagatgatatgtgacttaaacttgatgaaaatgttgaaaagttcagacatttgattcatccaaatatgtagttaattatgaggatttaggctgatgtgtaaattttatatagagtcaattattaattcaacattttttgagagcttagcatgtgcaacccagggacagtgcttcagagacacaaacaggaacaagatgccattctacctcagtgaacttttcatttgctcttcctcctggggatccaaccaggatacattttcaagcctcgcttgaagttaagtgtggcttgtgcataagttctggccaatgagatttgagtggacaagatggatgacctttctggggttgcccgtaaaactctaaaaaatgtcagagcctcaaaatacaaggagctgggattcctaaatcaccacctggaaggctgtccacttaacacctgattaaactttatgtcagagtgatatttatgtttgtgttaaagtactgacttttgaggcagcacgtgttacccaactaatataattactaattaacagttgcataaactgctacagtttgcacaatactttcacgtatcaaatgattctggtcaccaccctgagaattacatcatcattttgtttttcccatttctaaagctagaattgatgcataatgagtattgaattacttggtcacaatcacataggtaagacacagagggcaaatactctaaactgctgggtctcaaatttacaaaaagtaattagtataagacaagcatggacataaatctaatgcaaagcacttgataagtgtagacaaactactaaagaaatttaaaagaggtaactagaattctcggttgaaggaaggagccacaaaaggctctagtggaataggcaggctttatagcgtttgcaaattgacaagagaaatgggagaaaaaacatgaagaaggttcctgtaaattttgacatgcaatattagtggtgaacagaaatagaagagagttggcatttgttttaatgtttcaagggaagttgtagcaagcaatgcagtttgatgaaggaaaacaggaactggtaattcaatacaaatcaaaaaaatatttattgagtgcctgccagatggagggctttccaaaagtgtacagaggatatggagaggagataacaatggtgcagtccttgttttaaatgcatttatactctactaggggaaatggtcataaattactatacacaatgttgggcaagataaacatcagtaagaacagtaatggagttcaggggacagagaagtggcatgggaaggacaaaggaaggagaggtgaagcttcatgtaggaggtaaaatgtcaagattgaccttggaggaggtgaaaccactgaggatgcttatgaatacatgaattcatgagggacacaattccataaagaagggttttattaatgtcttgagcaaggacactgctttataattaagtgactccaaaatgtgaccatggtttagaggacaacaaaatgaaaattataatttggcatgtttgtttaaacatggagtcacaaactcaaaatgacatcatagttgtgcaaatttctactcctgctgaaactgcctgacttccaatgaattcagtgagcagcactgcaccccagagggtggtctactagaatttcatcctgcctccagaggaaaccaataggcagtttgctgtgatgtcctgccacagaagggccacctaccatgaacagggcttcataattttcaatcatcttttgcacaacagcgatgatggccgtgctctcctcagcccgggctgaactctgaactgagaattctttgtctgatgacttctgcttgtgcagcaggttgggtccaaatatggtggctaagtttagagatgtcattttattcccagtgacctataagagaacagaacacaaggactgttgttatgtttgcctttcaagatactgggtgattcaacaatcaatgaaaccttttactctccttttttttttttaatcctgcaaggatgccatcctctctgtcagaatccatggagggcatcattattttccttttgctttaatatcttggattgaagctcacagttcagtgatcatctcaatagcatattgaataaaaatttgcaactctaagttgtttattgtaaaatgggtactacataaaatttctatcctgtttgcacttaagaaatattgacacccatccatccatctatccatttctccatccatcccttcattcatcaacccataatctcaccactgatccatccactcagcacctatcataggctgggcatttttcatatattgtaattattttaaaatttttccaatgattacaacatagtccttattttaaaggtctctcattctagggaggaaataaacctatcacttacaggtaatgagtacaaagtataaagctctcaactccaaaggccccagggtcactaccacagaggcggaagcatttgcacaaactctcaaaagaagaatagagtttgctaggctgaaaagcaaaggatctgggctagggggtaattttacaatggagaaagcaccacacatgcaaagacagaaacatctaaaatacgtcatggagccccaggaagctcagtgtggtagggagttctgcaggaaaggcaggcaagggccaggtgagatgatcttcatgtgtcagaccaaggaattcaaactgtgatctaagggcaagaggattctgaacagagcagaatggaaatggaatctgcatttcaggaagagcaatctatggaacaggggatgggggatgcaaggaagtaggactacctgggacataccacaacagtctaggccacagcagctagcatctgaactaggaaggaagaagtagggatgaagagcagcttccaaagttacggagggggtgaagaggataatgcagagggtaaggatcttgtgttttaacaaatgaaaaaatggaaggacagttaagtgaggaacatgaagggctgaaaaggggttcctggagactccagcacccttaaggagcagctgatgaaggaggccaataatgggtgagaagttaccataaaagaaacctgtgtccaagaagaaatgacaggggagtttcaagtgagttatcaactgtggcagagggtcatcgagatgtgacccttccctccagaatggactctctgatggttctgatgtcccagctaagagtcatgtcagtggtgtggcaggaatgagccacagttgcagaagtggaaacagtgaatgtagacactttcttcaaaagatatcacagagaaggaggaagaagaaatgtaggaggagctaaaggggagtacggggtgaaggaagggaactattttttgcttgaagcataaaaaattattcacattcaatatattaataattagaaagcacaggtaagccaaaagaaaaaaaaatgcccataatttcaccactgccaagaatcagccattcctatgccttcctgtgcacatatatacatgtacacctgatattttcttctttaaaactgggatcacatccatatattattttgtaacttgcttactatctcttaacaacatgctacaataatctttccactacaaaaaaaaaaaaaatcctgtcttcaggcttcattggcccctagaatcccactgcacgaataaaccatgatgttttttaaccacagtcaactaataggcattgatgtcgtcttgaattttctgttattataagcaatggtacaaaaaatatccttgaaaagatattttgtgagctcgggtgagcactttttaggagtaaattcctacaagttgaattgttgtaataaggaatatgaacgttttcaaaggtttgggaattttttctacttgtctttctttcaggtgaacgggagagtctgagtaagtttctctaggctagggtttctctacctcgacactagtgacatgtaataccagatcattctttgctgtgggggctgtcctgtgcattacaggatgtggaacagcacccctggcctcagcccactagatgccaggagcacccctgccctcaacccacagttgtgacaaccagaattatctctagacatggtcgcaggtcccctgtggggtaaaattgctcctggttgagaaccactggtctatgtgaatttttatttctcttgtcaatatcagttgagagtcaggataagtatgggaactgcgtctgcttggtggggatcttttgcctgggaagatctacatagattttgagaaacacctgggtgcccagcatagaattcaggagtcccaatgaacagctgaaacaaagccctctgaaccccactctcatcctgtggcgtcatgagctggtggctgccctgccctgcaatcccagcttggtacacgagttgtattatttttagaaggcaaggctgttttcaggtgaatgattggcctccaagggatatcatttcatgtgataaacactgacaatttcaaagaaagtgccctttatgtaggatcgtccaatcatttttctttgttttatttcattggtaagttttttatttcattgacaagttttcatttaatttttcttttcctggaaattcatggttaaggtgaaaatcaaatacgtgtcattttcaaattcctccctttagaactcagaggtatttggagtgtttccccttacccctgtaaagtcatattagggttttctcattttttaaaaaaaacattaacaaatggaagattttgttttcttttaaaagaatgtttcatacgagaacaatctagagctctgtttccgctctttccttctcctgttgctattctgggaatggaatacaacccatctgtaaaactgcacacagattccagctgcagaccaagctgctggggtttgttaacacttttggggtttcttttgttttattgttttttaacagggaaagaagagttgctcccaggcaacatccaccttttctccatgtgtttcagcatatatttatatatatactatacggctgtgtctaggtaatacaacgtacactcgagccaggccattacttcattttttaattagctagcaattcaagaaaacttttatcttcactaaatgaacatcctagatcatttctaagcttcatatgaatagctcatatctgttaaaagtctaatatgtacaggtaccaggctaggggctttccactggccatttcaattctttctcactataagcttaagaaacagctgctgctgttgtccctattttatagacgagggaagtgatgtccaaagctcagagccaggagatggtatagaaagaagcgaagctggtggccccactctaggcagccctactctcttcatcccattgctacatctcttcctgtttcctcttgctgggcagacccagccatggcatggggaaacgggaaaacgagctttaaaacagggctgaatgagggtgaggggagacacaggtcttgctaagttccaaagccaaccaccatttcctagaggcatgtacctcctcagagattagtaatcatggccctacactggtgatttgtaacttctttttttgcctcatagaccctttgagaactcaatgccagctacggactctcaccaaacaagtgcatattcacaccacattttccaggcagtgccagggggttcttgaactctgaaaaaccactgctcaggaggtttcaattttgttcctgctatattctttcttgaagaaatgcaatgtttcttacacttgggaatttctcttttccctaaggagcaaagcaaatagcaaactaaacaaaatagaagaaaacaaaacaaacacaagatagcaaaacaccacaattcaataaaatactgctattttttcccaaaaaagcactgattggtcaacaatttttctcatgcccttcttttagacatctttaaggtctcaccagtgaatgatgcattgaattttaagcacatatcaaagagaaaatattatgttcattttgtagatgaggaagctaagaccaccccccatcccaactctgttttccttcctcttcctctctttcataaagacaagttatgcagcaaggtgctggcagaacctgtgtgagctttcaagcttcttgacaatctgcttcaggtttcatctatgttgcaatccccccaaacaacaccctaacaaatagataatacatactaaaaaaatagggaagagaagaagttgaaaaatattggtttttgaccatattttacaatttggtatttagttttactccagtctgcccattccatattctctacctgctcatgccaaatcaactaaaaaataataaataactcctctcttgatcctctccctctacccttgacttctaacagaaggggtttggctaactcccatcccaatgctgtgcttatgtggtccatgtactcaatccctacacaccctttgatgtgcatcttaaattcaacctcctccatgaagccattcctaacttttctggcccatgctcatcacttctccgaatgtctgcaatgactctgcagtgcattccctaattctatatttgccttgtgtcctcacctcctccacctcttagatgccattgtatcctgaggccagtcattagaaaatttctgagcaatagtcgttggtttacaggaacctagggtagatgctcaggacatgcatgattcaaatcccaaggccattctttctttctttccttccttccttccttccttccttccttccttccttccttccttccttccttcctttctttctttctttctttttctttctttctttctttctttctctttcttttctttctttctttctttctttctttctttctttctttctttctttctttctttctttctttcattcatttatttatttttgagatggagtctcgctctgtcacccaggctggagtgcagtggcgtgatctcggagcactgcaagctccgcctcccaggttcacaccattctcctgcctcagcctcctgagtagctgggactacaggcacccaccaccacgcccggctaattttttttgtatttttttagtagagacagggtttcaccatgttagccaggatggtctcgatctcctgacctcgtgatccgcccacctcggcctcccaaagtgctgggattacaggcgtgagccaccgcgcctggcccgccaaggccattcttacatggaaatgtttataataggaattgctgttgtccatattactattgatacaaaagcctcctaactcactctccctttgtctctagccaatctacaacgtggatcatatcacccattagttgaatccttccaaggattcacagcttaaaagaatcaaccacctgccctgcacagaggcattcagcaatttatgaacatggcccaatttcccattgtctccctcagtacttcactgctccgtagcctttactacagttcacaatggctgtgagagctgcctgctctcctgtcactgctaacgatttcacggaagcaatgctttccttatatttctcctgctgctttaatctttggctattagtctttcattttgatgcaatgttcaggtcaagagtgtctagaaaccctcgtaaaccctggcttccttttacaacttcactgtcaccaggataattccatattccttacagtaaactaggtctctcaaccactcttcaaggctggttgaagaattttcattcctcaagttcagatgaggagacccaggtataggaaggttaatagatttttctaacaacacatggtcagtgaattaaagagctatcaagcgctctcaaccaggggtgattttgaacccttctcctcaggggagacctggaaatgtttggagatatttttggttgtcacaacttggtgggagaggagatgtactgctactggcatctagtgggaagaggccggggatgctgctaaacatcctacaatgcacaggacggccccatgacaaagaattcctagctccaaatatcaattgtgcagaggctgagaaaccatgacctagaccccagtacattttttttttcttctaattcctattctgtacgtcttttctcttagactggctcaggttctatgcacagcttggactttgctagtaaggggaccaacccaacccattaaccagtataacgacattgtccttcttcaagatctttttctatcatccactgggatactgtcctaataactctgcaaatctccagtgactatggggtccatggcacctcccctagagttgtgaaatgcactaatatgccactcgtacaaccttaagtggaagctctctgtgggttgctaggtaagttacttagctcccctggccctaagttttcacttctgaaacatggagacagtgatatctcttttgcctgttaagaggatttgcatatatatatatatatatatatatatatatatttgcatatatttatatatttatatgtatttgcatgcatatatatatatatatatatatatatatatatatatatatatatatatatctcccctagcacaaagccagctcatggaaggagagacataaatggtagctaatattccagcatgctgtttcatttacacctgtccaagaatattttcttctttttggcataggcaatggagacttgttcagcaattgaatggaaagaatgtctgaaaatgattctaaaagggcaacaatgagttcgattggaacttttgctttcctcaatgccttcctaattacctgagacccaattttctccttctcacacagtacttaagaaatgtcagagaagtaactggagtacctttaaacacagagctctgctttcccccagcaattaggcagatcatgctacagcttctgttataactgtagttgatagaggttggcatccaaatgagtaataaaactacttaacaattatgagaattatagtatgcccatcaaagagctgtgtatgctgaaataaggtgtcagtgccacattatgaaacctgaagccatctggggcttcactaattataactgctatagagataaatggctaagtcaggagagttccattctcacacccgtaaggaggaggacgagaagaaatgcagaattgcctttctggattagagtgaaaaaaattatacataaccacgttctttgggaaagaaatttgacaaacacagaactgaagctgcagtgcagctgagctttgtttaacaagaatttacaaaaaagtttctgtggttaagtaagtttggaatgcctctggccccttcttattgatttacagtgcatgttagcttattaaggagtctaaaacctcctgaggaatccgaggtcagggagaggtataactgcatggtatcaaagagggaagggggtgtctcttgttaaggtgaagattaaatacgttgcccataagtaagcaacttaaaattcaagccagcatctcatttgtccaagggtgaaacaaaaaaaaaaatcttgaaatatatgagtgtaaccaaagagaaccagaacccaagatcttagatttggtgggcggggggggggcacactggggcctgagtggggatcagatccaacaagaacatttctaaagagtctgtgggactatgtacaacctgctttgagcagttgataccatgtgacatcaagacacaatggcaatggtcagcagatcagacccagtttcctccacacctggtttggaagcaggactgaccctcccttgcatcgagcaagtccctgttttggggggagagtttaagaaaggaaaggatcccttgaaagggagacactagacttcttgctcatagtgcagatgggagctccagggataaactggaagaataaagaggtgacatcatatttgggctccaagttatagaagcaggtaaaatcaattataaggataacaatctcctcccacccccatcattccacttttacatggttgcaagcacttctgtagttcactgtttttcttctttacaaacggaagttcagagtcttgagtaaagcctcaccatggaaaatgacagcctcatttggaagcatacttgaaacatataaggaggctcatggcccatgcacttttaggaactgtgcctccagagaaggccctgcattagtctcttcctacagagacagctaggttggagaaggggagacatcattacctccaggcaaaatggccattttggtggtatgcccttttaaaataggggagaggaagagtcacggcatctatggcagcaaaggcatcttacctcttgcccatctttgctgatgttgtcatcggcatgcctggccacgatggagaggaactgtagcaggcggtggagggtgtcgcagttgcagggaggtagaaggtatatgaggagctgcaaggtgcccagctgttcctccggctccaacactaagcaaggcaaaaagaggtactcaaataaaaggggagcccatactattcaggcacagaggaaaggcctcctctcaattgtcttaagaaagggattatcaaggcaattcccatttcatgccttcactcatttgcccattgctttagcaatttaccagcaagattctatgaaagatataaagccaaattagacctcgagaagtgtaatacctagaaaaataactgtaatccaggtaaaaaaaaaaaaaaggtaactcaatttcccttactttcttctccccccttccctggcattactcatcacctagtttaaggatttcagtcttccatttttggtaaatatttattaacaatggctgaaaattggtgaacattctgaaatttgagtttataatggatttaaggctcttttctgttgagcaattcacaagggacagatattttgttggcaataaccaagatacagcaaagccaatgtcttctctctccgttgtgatcctatttgaatggcagcattggaggaagaaatgtatggaggttgacccaggtttggcctatctctcctctacctcctcctttttttcttcttcatgggatctgtagctacagcccagaagcagctatgttgaaagccctggcactgggctatggcatcttgcttctcctggaatgttgctgccctcctttctcactctgggttctcgtggttccctccttcttcgtaccagaaacacaaactcatttttaggcacagactcaatgtgaactcttgttggtactctaagcactaactcatagtactttttactgttcttgggttatttgaaagcatctcaaattcttcttggctatttccatttgttttattgtaactttcttcttgctaattattcccagggtaaatctgagaaattccctcaaatagctcactctttagagattgataaataaggacaaaaagttatcaggaaacatatgcataaagttatgatgaatgagttggacatcttagtattccagggccactttcccacatatggctgtattacgcacagagagtgttgatgaaagctgtgtacagctccctggtgagaagggggtctggcatgtccctcaggaactctttcagcaaggctgccacatcatgaacactgtgctcctcctccagagagacatcaatcccacggtcaaattcctcacgtaactggaagaacaatggttcgagtggcagtcacataacaccatacctcaatgagcagtgcccagcaggagaagtgctgtgacacgtagcatctggaattaagactgcacagaccccaagaaggggaagcaaacaacatcctcaccttgatctgccgagttgacacagtccagctatgaatatgtgtgtgtgtgtgtgtatacatatatatgtatatatatgagtatacacatgtatatatgtatacatatatacaatatatgtattgtatatatatgtattgtatatgtatatacatatatatgtatatgtatacatatatatatatatatataagcattattaaataaaactatctgtggatttattgttaatgatgtatgcagaagggcttggtaatgacaaccaggttaggaggaacacctaagaggtagaagacaatttaggtcagctataaatgtgggagggaggaattaatctattacacagcatttctgtgtgtcaccaatcctgccatgtttggatgttgatattttactgagtcactctataagaaagcaaagagattttttttttctgcaaaaatgaaattaagagccctgataacacatttatgactaagacttaaaagatgacaataactaaataaaagctgtcttagatttgtcaaagtagtcttattaacaattaccagaaggattccctgccttaatcattatactaggtctattatcacttgcagcagcaagaaaacacagtagcaagggagtaataactccacaccctacttttatctctagcagctcaacttttcgtatgcattgttctctgctgtagaaataattatgtaacttcataaacctacactatgcaaaaaacttctctaagagttcatttgttttcaatctttcatccatccattcattcaacaaagattactacgcatttcctgtgtcagaccctgttacaggctcacaaaatacactagtgagtaaagaggcaaagtccctctagagaaacaatgtgataagcaggtaatcccacaaataattcactcttaacattgtggctagtgatctaaggaaaaagtgcagggtgctaaggggttatataacaaagtaaaatgatgagtgagttagggcatatttcatacttgaaatctacttctaagtaaacactaattatatttttattgggtaatccttaaatacaactccatgcaaaggtttcccctttaatggatcccgatataactgatgagtaatttctggcactcgctacctgtccacctgatgagaatgaatacccatcactgtcctgaactactcattgattccagacagcacgccatcagcgtgtgtcaggcagccaaaacaaagaagacttccactggcactcctccaacttgtgatcattcaaacacaccatgcttcttttctgagtatacgtacatgcagaaagaatggaacatgcaaagagtttggcctatgaagttaatggtgactggttaaactgtgtgatcttgaattatgtttcttaatctctataagccttgacagaagtgggtcaaaggggctacactcacagccggttggcagattcagtgagataatatttgtaaaaatattctgcaattctgcacagaaatgttactgtactatctttcttcctgcaagttctgttgtgaaacattaaatgttgatccatttaatgtttcttgtgtaactattaagaataaaaaccaaccaaccaatcagaaaacatatttctgttgaaagccttttttgtcttgacaaaaaagataaatgaggtatttatttcaattactttcaataatatgaacaaatatcatttcttcagcttcttccaactaaaatttattttcatttgaattcatttttgagttgctgagttccttatctccttccattgaaaacaacaggaagaaaataatgctttaattttccttcaccaacaaatgaactcttttctcaaaggatggtttgccttttatgaagccatcatgaacacaaatacctgcctcatcacaggaacctattgttgaaggtctaatatcaaacttcagttgcaggaatgttgcacagggctgaaggaaacaaaggagcacagtctctatgtgaaaagcaaactgggggtcaatggttctatggaaacttcataagaattatttatttttgataaagtaaagctataaacatagcatcttatgtgaagggaatgttaatggcatttttcatatcacattttagtaaaagcgggtgctacatacaactttatatcatttattgatcagtcactctgaatttcctgcttttgcaattttcaataagatgtttataaattagttttgtttggctgcacgtggcacagatacatccagacattttgctttcaagtgtttgatcctaactgtaacaacatttctgagttgttgccttttacctcctggaattcaattatattataatagcttggagggtaaaaaaaaaaaaaaagataatcaaaatggaatttgcataaacttgaactttgcaaaaggtaattcaattgaaagtcatgtgaaacaaaatataatctttacttttcacttacttgtctcactctcttttttgagcttccaactcggaatatccccactgtctggaggcctgcaaataagcaaacaaaatgaacagtcttgtttcatggcttgagaccctggaggaaatcaaaatacagagcagaatgccagcacagtgccgtaacatgtagagcaatagtaacttgacagcatacagtaatgcttctttcatctcacactatttctattatccagatacttaaaggtcagccctttaagcaccagaattttacgttaaatgtttctgatcaaatatttttcttgtgatattttatatttctaatcttctccttatcagagaaaatgagcttttgtccattatccagaattattacctaaacacacattttatagggattctaactctttattaatttctaaaagatatttcttgttcgtctgatcataattaaagtgtgcttcttaaagaaaatctagaaaatgcggaaaaatgtaaaaataatatacttttagaaatacctgatgcagaaataatcactcttcattttcttttcttttctttctttcttttttttccttttttcttttttttttttttttttgagatagattctcactttgttgtccaggctggagtacagtgacgtgattacggctcactgcagtcttgaccttctgggctgcagtgattctcccaccttagcgtccagggtagctggtactgccagcacatgcctccatgcctgactaatttttgtattttctggagagacagggttttgccatgttcccaggctcaagcgatccacctgcctcaacctccaaaattgctgagattacaggtgtgagccactgtgcctagctaatctttcattttttaaaatccagccttttctacatgaatgtaggtatttttacatagttgagatcacactgcatatatataatatctattgacagagagaatgttactgccttccctcactatcgtgtcgcatgaattttcactcatgctagtaacaattccttataaatgtcacttaaaagggacaaaagactacaaattgggtgtagtgtatactgctcgggtgatgggtgcaccaaaatctcacaaaccaccactaaagaacttactcatgtaaccaaataccacctgttcccccaaaatctatggagatataaaaaagatgcaaaatattctattgtatgaatgggccataatttactccatattcccctctgaatggtgcacaggtccccaaaatatacatgcttatttttctactataaatgaccctattgtgaacaattctgtgcacacgtttttgttcacatttctgattgcttttcctaggatcatgtcctagatgtgaaaatatagtgtcagtgctgaggttgagaaactcatttctaaaaaattaggtctcttaaaaacacaagtaatttcactatcacatattagaaatttcaacaatagttccttaatagcattaaatttccagtcaacatccacataaaggtcacacactgtcatatggtcgatgtgccttttagtctcttaatctgtgtttcctccctctgtctcctttttccttataattgttttggtgaagaaatctcagtgatttcctactgtagatcttcatattgtttggatttggacactccatagtgtcatttgtatgttcttctccctcttttattttctgtaaagagatagctagagccagacattactctgattgcggtgtgattttatagggcaagaatacttcacaaaaagtattgtgtacttcctttgggagcatgaaacgtctgaatggctctcctttttctatgccagtcattgatcattgccattgatgagcatcatgtatattaattctttcattggtggctcattttctcttcatttgagacaatcagttatgagagtgatgggatattggagctgctaaccgccatttgaagccacatgaagagaactgtctgagaataaagccagcaaacagaggacactcatgacatcgtttgaatcctggatccagccgtgcctaaatctagatcacgctcccagtatataaagattgttgttgttatttgggggaggtcactttgcttaatctagttttttctgagttcctttctcttgccactgaaaaatttatgactagtacaatatataattaaatcagaaagaattgtatttttttaaatatagaattggggtcttgctatattgccctggctggtctcaaactcccaggctcaagggatcttcttgccttggcctcccaaagtgttgggatgacaggcgtgagccacggtgcccagccttaaatctttataacattatttctttacatccagaaacaaagtaaacatctcaatttgttttagttgtgttttctatctcttggtagaaagagaatagtcccacctgtgtagaaaatgtccttatgtgatatcttgcttctgtagaaattttaattattcagaaaccatgtgaaaataaaaaaataaatgcagccaaaattaaaattactgtgacctactattgaagttttctatttcgtacatagaagattcattcagttcactcagagtctatttctctctatataataatatatgccaggtactattctaagtactgtatgcacattaattaattgaatcattgcacaacttttgaggtgggtacttacgttcattttgcagatgaagaaatataatcctgtattttattctaaatagtgtgattatccggttttcaagcttccaaagtgatagaagcaataaattaggcaatttcattattgtgcaaacaccatagagtgtacatacaccaccctagatggtatagcctactatacacctaggccatatggtagagcctagtgctcctacattacaaacctgtacagcatgcgactgtgctgaatactgtaggtaactgtaacaaaatcttaagtatttgtgtatctaaatatagtaaaggtacagtaaaaatacagtattataaccttatgcaatcaccattgcctatgcagtcagtcaatgaggggaatgtcattatgtggtgcatgactgtgtgtgtgtgtgtgtgtgtgtgtgtgtgtgtgtgtatgtgtgtgtatagagaaagagatgtatattcaagatacataggtgatacacaggcaagtgaaagataaggtgaaaaaaattaaaagaacctacacttaaaattttgtataaacaaataagattttgctacattagttttattaggtcatccatatgttatcctatgatttccattgtaatgaattaagaaatttaaatatatccttaatgattttaaaataaagttccatttttattagaaggaaatagatgagaatgttaacagtagttatatctatatggtagcctcagaattttctttgctttcacgtttacttttttattacaatgagcatattatttttacagttaaaaaaagtaattaagcttttcccatgtatataaaacacgtgctaacaaacactatagcatacaaacttagtttatgaaaatggcagttaataagccagaagtctaaatttcagaaacatttttgaagaactgtatatcattcttaagtcaacttagtaactagaattgagttgcaaagggtggcttggagaaattttaagtggacagcttccacaaaaatgcaaatagcaatatgtaaacctgttgtcaaaaatgatgtattttctattcacttaagcaatgattccccaattttttttttaagttggactcttactttttaaaggaaactttgtgagtaacctcctaggctacttttatgtataaacaataaaagtggctctggtctgtttgaaagaggtcctggtgacaaacccagcccaacagatctgatcattccctaaactgcttggcctccaaggtaacttctgaggactactgggagctaagcagtctgaatatcatcaagttgattcaccctcttctccaatcttgtttagccccacaatctcttaagcaaacactcacatctgtacactttcacacagtaaatttcagttcagagcttgatcatttgatcaagcagaattgacattgggtacttcagtgaatgatgcttgaataaatgaaagtccttagtactttagacagacaagtctacttaccatgtttttctaggtgctgacagcagctgtccaccagcctagggacctgtctgtaaataggattcagactgagtttcttatctctggctttttcctttttactttgagcctcagcaggcaaggaaagttgtaaagcttctagtagtcgagactgattgtcatcaagatcggtgatagaatccactgacatggcaccctgcaagtgacacagagccgtgaacataaagtacagatagccaaaaaacccagctgcccccagatgctaaccaatacatacttttgctcatgactctttatcacacttgaaatactactgcttgatttctttaattgttctgtttgtaaattaaaagaaaaaagatgccttttgaaaaagttagaaaacctctacaagatttcctcaagctaatggcagttacaatttcaacaatagacaacattttccaaatggaagaacaagcgatgggaaacatataattaaagtattttggcccaaccacttcatttcttgaaacaagaaaaaaattacatactcaatcaatgaggtagtcagagaagtcttgtaaataaaaaactcaactatggctctaggaagtatatttttaaaatagaatgattccacaaaacagccttagcttagttttcccgagaaacaacacaaagtgctttattagagaagtggtcctgggaaacacctgtaggggaggggggaaatgagacaaggaaggaaaggcagctgatgaagggagcattatcaagcctattatcattgtgggcaactggagctcaatctttctggggagctctaggagacagctgtagatcatgcaccttagagctatccctatcaagtgagagagctggggtatttatacaccaggcctcaggaatcactgcttaagggtagcctctggtgggggcagagagataatattatctcctaagtacttacagcctgccatttggataggctgggtgcctctggcatcagagaaagccctcagcaaataaataaggtgttggcagatggaagatgagctggcatgctaggaatggtaaagggtcagggaaagggagcagggcaccagtcgcatttgccgcacccatacttgatgaagcactgagaaagcagttggctagccaggcctggacagacgagagggcatttgggaaaaccattgcctgagtcctacattcccagaaagctaaaatttagagttttagtgttattgttgtacgacaatacacagtctgagacacaatgacagaattagaagaacaattccatcatgcaacttcaggaattccataattttgtaatttcttcatttttaaacatagtcaatactgcaaaaacagcaatggatcaggtccccctctaccttggacaagccctaaatgttaggggctgattgaaaaatgttggttttaagtgggaagtgtctggggttttaactagggcagtcttcaacagctggaggtggcaaaaatttcaggtctccacgtgacagaggaaaaagggagagagggtcaggcgtggcggctcacgcctgtgatcccagcactttggatcacttgaattcgaaggttcaagaccagtctgggcaacacaatgagaccacatctctactaaaaataataataataacagctaggcgtggtggtgcgcatctgtagtcccagctaccggggaggttgaggcaggaggatcacttgagcccgggagattgaagctgcagtgagcagtgatcatgccactgcactccagcctgggcaacagagcaagaccctgagtcaaaaaataaaagataaaaataaaatgcagatttgttttacaaaagggagagaagatcttccagtgacctggaagctttagagatgcttatcaactgactcagccaatcaccaaccagtttgcatgaacaattcaaataatagcacagtacctagaacatagtacttaacaattggtaccatatagttagagtatttgaaagaggatatatagaggattctatggttctgtttgagaaaaagaaatgctccattgataaagaaaaagctcattgtttatgaagacccaccgccaattcatttggccaggcatgttctcagactggtgatgaagaaagtattaatagctaaaacaccaggccctgccctcgagcctcacagtctagtgggcaagtatggcaagactgacagattacaagagaccagaattaatggtgatattgccgaatgtttaggagagcatggagcaaagatgtgacaaaggagggacacccaacagcttcaagaggagtcaggacaaggtctgaggctatgcaaggtgccacgtgcccagtgcacattcttcattaatggcattgttgacagatacctgaacaccaactacatatccagttttcacatgaacaaaaacgcaaagaataactgtacatcttcagttttcctagcactggtgtcagagcaaatactggccacctcaccctcctcctagcccgaggagccggttccggggtgtttggggacgttgactcattcggtgtttctgaggttgagctgagagatgagttactgcttgagagttctttgttttgtcttttatttccaaatgggaggagggaagccacaaagtcagatgcatctttctgctcgtccctctgcaagtcctgcttgagtttataggccctgtcattcgcaatgacttgggataagggcattccaaatgcctgtgggatgaattctggaatcaaaaaacagacattcactttcagagactgactggtccagtgaacactctcatttatgtttcagacctaagtaagaacagacatattcaaaggaatgttttctgaagaattgactcatcaatcaaaaaggtgacatttgtgttaatcagaatggcccaagtttccatttcaataaagaaaactagtatttataaacacacatcttagacatttaggtctctagtttttctccatgtttcaagtctatccattcattcaacaggcatttattgaatgcctactacatgccacaacaagctaggcaatgggaggcgcaaagcttataaaaggtacagtcctttctcctgaggtgttcagagtgtgggttggggtgaaggagtggataatcagaaatgcaaatcatgataacagagtgagtatcaggtgttagagagatgcatgaaactaaggctgaaatttagttaactgaatacactttgaggttcccagtaagagttagcatgtgaaatgataacctgacaggcagaggagcagcttgggaactggttgggaagaagtccactctgttttcgttgtgttcctcatccctacattctatttccagccagctatgttggggctgtcactctcgtgatctacactcaagccattctactggccacatgcagagtggactcagccactaaatatctggtgggaggcccaggaaacaatttgttaaatcctttagtaaggagaatttggggaaaggggcatagtgcagaaatcaatggctttatttggagacatacatagagttcctttctgaatttctgtcgtaaatctgtttgtatacatgtaccttggatccttagggccaggagttttattggcaatattttagattcatgctgaaaggcactaaataatgtaatcaaatgtattattctttttagactccaaattaggtctcctagcagcagtaagttggaatctaacctctccattgtttttataagccctatgaatgaaactaaaatgatcaagggaaaataattctaaggttggttgttctttgaaagaaaaagctaacattaaatcaggtagaaagagactttaaaaggttttcctccttgatccatggcaatatttcaaacatcactgggctaatgaccaagtctacattaaaagcagaaatgctacttgaaaagcctgcacctctggttctatcaaagcatgcaatttgttttgaagtaaaaaagtcaaaactttagtatttcgggattttcagaggatgcttgccattctttagcaacaagctaggtgatatatggtaataaaaaataattaggtacttctcctttgagtgatcaatttagacagtgtagtgaggtgtaattctcactattgataataggctgtgtctactactagcaaaattagaaaccaaaggggatagtaccagacctcctgttatgtaccctgaggagatatatatatatatatatatacatatatctatatagatatatctctatatatacacatacatacacacacacacatacatataatcttgtctgtagaaatgatcaaatattacttttaaaaggttggaagagtctggaaacatgtggatggtaaggctgacagctacatgaaataacagaaacagaggggataataagagtgaaaagaacattgataaatgtagcaagtgacatgtctgctcaggtgggcatatgcatggcagggatttactataagatagggactactgagccctttcccagtcatttttttccatctaaggaaaaccaaccagactcgtttagagacttcttatacctctggggcagatcttccccaccagcaaataattctgcctcctgtttcaggagaagagcaaccagcaggtgcaaaggctccaactcttcacacctgctgtacctgtgccctccaccaccctcctttgcatgagatgtaggtgtgacttggcatcctgccagcctttctgcctctccctggttcccatgctttcccacctgccattcaactatggataactttaaaccatggataatggtgtactgcactcaagagctcaaaaaaattatcctaatactcttaggtataaatagcgttcagcaattttctgtaaagggccagatagtaaatattttaggctttgtggatacggctggggcttagaatggctaggatgcaaaatgataaggtgctcgcattcagcgtggggcaagtgcagagtcagcatgcagacttggcatttctttcaattctgtagcctaggggctcaatttgtctcactccagcctccgcactgttggcaggttgcagtctttgtagcagctactcgacctgccagtttagcaggaaagcagccacagacagtaagtaaatgaataggcatggctgtgttctagtaaagctttatttacaaagacggctggtgggccacccctgctataaattacatcttcttgtgcctgtatcttcaacctctttttttctactagatattttgtactaaatttattcaagcagctatttcttaaaaaaataaacaaccttcgacccactcttttcttttctccatggtttaccccctctccttttgccacagttaaaattgtctaaagtgttccctttactttctagcttataactttctcacctaccactctttcctcacttcatcccgtctagctggtacctccattagattctaaagcagctccctctaaatcattgctgtcttcagggtcattaaattcagtgtttttgacagctctgtttcatttgcccttctgtcagcctttaaccctgatcgccatttcctgaaatgctccctgtcctttgcatcctggatatactaactgggtttttctctacctctctggctacattcttgcccctttttctggcttatcatcttctacctgggttttcaatgtggaaggtcctcagagctcaatcttaaccatcctcatcactctggtctctctctgtaagtgacagcacgatgcccgtaacttaaacttccatccatagatatttcacacctcattgctacctctagctcagaccccttccttgagcaccaaccacttcttccaccttcatatctggatgtcccaaaggcatttcttattcttcatcttcccttatcaggtcttactcagatttccaaaagtttgcctgttcttcatgtgggagaaccagaaatctgagagtcatccttgatacttcattccttcttacatctcattttcactccgtcatcaaatctttatcatgtcactttcacattatctcttttttccatttacttctctccacttccacgatcactcccaccctagcctaaggtaccattatctttctcctgaacttccaaatcagaagtcatgctgtggcccagtactgtgtgagctggccccttcctaaccttctcagaaaccacacactccctggttctttcttctcttcttatcctagaagtactagcactcaatgacaacattcaatatatgttctttgagaatttctacatagtgataactgataacttgattattctgctatttaatgtggagcaaaattaaaagttgtatgagctatttgtatatagtgttacttcacagctcacatacagttacatacctagacagtgaggaaaagaaaacatgatacaatatgctttcaccaaaaagaacagtgccagaattgaactctttccagattgtatgtagatacatatatggcataatctgaaaatgtcctggcaggggttgtggggggtacaatctcccagagttacatcatagtaaaacctattccccatgtgctcagtttaggaagcacattaataaaacaaagtagctatttttaaaattacttaattttaaaattacttttgacacagaaattttctgaagttctgaaagttttaaaaacacttttggttgccaagaaatataactaagagaaattaaggacttggaattattctgtatgaaaatatgttttctgatcagtgtcaatcttgaattagttcccatatgtaaatcaaaagtcacatgggcactgcctaagtggcatgaggaacataggagtgtcacaagatctgctgtatatcaaggcaattaaataacatacaggatatgattcattctgatgaaatcaattaatatggtagcatatcaaccatttatgaatcactattgggagagcaattcgattctaaaaggctgcttctatttatttttagatgacctaactcaagagatcatttagagtttcctgttttccttcttttactcttggattcaaatgatcgtttttcacatgtgcagctgttacaaatccaaatgctaatacgcaactggaaggaaataatgtgaatagattacatctgtgccagaccggcaccccgtcctcctcacaccctggttcccaggatatccatgtaatgactctcagtgttgacatggacagggctttatgttctgaaaagatgccatgtaattaaccttcacttaagcctaggttagtttgtttttaaacattaaagctacttaaaatttttttgttttgttttgccatgaagcctgatatttctccccttagttgggtgggtgatatgtcttttctttggaaccaccaggatctgccttccttttcccacttagctaccttcgaggcactatagaacatttcagagttttcactgagcctatgtaaatatgatttagtttaaaaaatctataatggcccagtatgtattgttcgattacttccctagcccttccttccatgttaattcaaattcttgcttcctgctgctttgtatatataatacatgcaagcaaacatacatctccttctgttgagggaacatctcatcattctgttgagggaacctcctgcaaaaatgctcattctgcttagtctagccaaatggacactttctgaaaaatcacctaaagtccacattagatgtatttgaatcccaatatcaatatcatcatcctagaataaaccaagtttaaaagagaatacattactaataccaacctgagtgatccctttaatatgctctatacatatggaaaattgctctaatctggagacataaaagtgctctactgcaggaatagaatgagcaaaaactctagtttaaaagagcaatgctggctattaatatttaggtcattacaaaaataagggcacaaacatatcaacaattaaatataacacaatttatcagactataatagctagctggacaacccttagccctcattattccagcagcagattctgctgtgacagaatgtggcctggtgagtatcctagttaatatggatcaaaattcttatctagaagttgcactttagacgctcttaaaaacacccatgcctgaggtatccctgaagaacacgaactcagactccctggggtgtgggtcttggacttcttaaaggttccacaagtgattctattgtgtagtcaggggtgcggatcactgacactttcaccttcttttttccaatttgagataaacatttgaaatgtctgaagatatttgggttgagggtggtgtcactggcatctaatgagtagaggccagggatgctgctaaacatctcacaatacacaggacagcccctaccccagataattatccagtctaaaatgacaacagtagcaaggttgagtaacctcactccaaaggaagtaaaacaatggttttccattctttagaattcttcacctttttttagtctaaagaaccaaatgtcatgactgttcaagatataggtgtagagactgagatcaatggtatggaatagctcttgtccaatactgatcccaatgcatgttttaatacccttggtttcatcgccttccattacttttaaagcagaaattctatcattatataaaaggactccaagatgagatgtgtatggctgttctcattcaagactcgttgactgtgtcacataaagtgaaaataaatgcatacaaccataccattcagcaaccacttcataacagactataaaaataagcagcaaaaagtgcggtggctcatgcttgtaatcccagcactttgggaggctgaggcgggaggagcacgaggtcaagagttcaagaccagcctggccaacatggtgaaagcccgtctctactaagaatacaaaaattagctgagcatggtggtgcgtgcctgtaatcccagctacttgggaggctgaggcaagagaattgcttgaacctgggaggcagaggttgcagtgagccgagattgcaccactgcactccagcctgggcgacagggcaagaccctgtcttgaaaaaaaaaaaaggcacaaaaaattggactgcgtcaatggggctcaggtgtccattatgtgagcttgaatatcagttttaaatgaccataaatacctcagagagtggctaaagttttagtttcctaaatatatgcacaaggggacacaaaacagtaagatgagagtaaacaattcccaaaacatatgaagcaaaagatgagtatactgtgatctaacataaaaatgctgagaattcacttacaagtgggagctaaacatgttcatatggacacaaagaagggaacaagacacactggagcctacttgagggtggagggtgggaggaaagtgagaattgaaaaaccacttattgggtactatggtgcttacctgggtgatgaaataatctgtacaacaaactcttgcaacacacaatttacctatataagaaacatgcacatgtacccttgaacctaaaacaagagttaaaaaaaaatactaggccgggcgcgatggatcatgcctgtaatcccagcactttgggaggctgaggcgggtggaacacaaggtcaggagattgagaccatcctggctaacgtggtgaaaccctgtctctactaaaaatacaaaaaaaaaaaaaaaaaaaaaaaaaaaagccggttgtggtggtgggcgcctgtagtcccagctactcgggaggctgaggcaggagaatggcatgaacctggaaggtggacgttgcagtgagccaagatcgtgccactgcactccagcctgggtgacagagcgagactctgtctcaaaaaacaaaacaaaacaaaacaaaacaaaacaaaacaaaacaaaaaaactaatagccactgactattccctaaagttcctggatctttaaaaaggaaaatacttgttaactcaagtgaatatctaatctgggaattcttaatttagggggtggtagggtgggcattgggtgagtttcaggcctttgatagagcatcatcattgtcaatgattcttaaagggctctgtgacccccaaaatattaagggcatttgctttaacctatcttggctgaggcaatgtaacaaagtaaaatgtaagcattcaggttagttgcaaataaatatttttcaactgggtgaaaaaaaaaatgctgagaatggcctatcttcagtaacccatgaggatgagactgtttctttccagtagtggtggtaggtgaattcaaactctcattaaactaaccctgcctgtctggatttgccagacagctggttagcattagagatgctctccatagcttctcaacccaggtcctctttatgtatagctgattggtcaaaataataattggaaccacaaacttggccgaggtcacactctcctcaaaccagctgaattcatcagttcagtacagggctgctcaaacacagaagagtagaccaaaacagcccttaatgacattccactgtagaaatccagttttcataacagagttgaaccacgtatatctatgcaattcaataaccccaccaaatttaaccattatgctccatggaagatgcatttacattgggtactttaccctttacctttgtctttgtttttctcctttcctagtgaatccagtttctttcttaaagatttctttctcttttgtccatctgtaaatattaaaaggagaagttataaagataaacatataagtgatattttacagtatcgataattacatttgagcaaaagcatggcttttctcttacttcacttataatttgacattttaagcagagtaacagctctgagaatacatgaaaatcctgacttggataccacatattaccagaattttggtgtatattcttgaatttcctttcagtcatggaatgataggaaacttacctcatttggaagtaatttagctttgacatttagataggtttaattttactattatctaagtctcttcctcttctctgtggttacataacttaatgttcatcttgaacctaatctccatgagaagagaatcaacagcatgtatagctttgacatttacgagctaggagagtataactggataagaaaatggatttggaggtccatagaacttaggtctaactattgctgcacaatttactatgtgactttggacaagtctttgtgtcctcatttataaaatgggaatatcacaaggttgttgtgagaattaaatgaaacaacacatataaagctcttcatagggagtctaacacagttcaggctactttctttgtggggagttccatggtatagctatactgcaatttagttaaccattcctccattgatgaacattttggttgtttcttactgtttactataataagtcagaaatacattcttttacagtctagtatttgcaacaaatgtacttaatgtgtctgcttaactcaccaaataataaagataccacttatatcagtgggcagctgcaatcaaattcttgggctgtcatcataaaatattggcattcatcattgccagaatgcgttttgaggttatgcagctgtcaacttagcatgtgggaggtgcaaattcagaatccacactgtgatcaaataggggacatgcagaccatgccacaaggaaacatatggtgaaaaaaatgattaagaattgtttgtacaggacacactaaaaatgtaaagaaagagattcagcccaatacatttaaaagcaagactataatatcaggataaaacagagtaagcattatgaaacagaaatgagcattcctggtatcctcacagagttacagatgtcccccactcctcatttttggaaggaaaaagaacatcacaatataatcaacaggcacattcaatccttccttcttttcaaagatttcaaaaatgactctcctgccaccaaaagaaaatagttcataagaatcttcactcttgtagtcacgcaatttgtattggggaaattatgtaaatcagttttaatgtaatgtaattgatggcaacagccgtcaatctctcccattatgtatgtgttcatagatatgaacaacatctaaaagatgatctactagggcctgtcatgacttattacacagaccataaacatgctaactgtacaagattctaatctgttctccaattaggccttacaggtcttttactctgtaacactttgttcatagctagttcatatctcaaatgtatttggcagtaacaaaaattctttcatttcaatagttgacccagcagaataactaaaccatctattaaagcttaaaagatttgatttttcataaccaatgggcagatcctaaaattcaaacaagttgccaaaagtcagaatacataccagatagaggacattatttttaaaagataaaatgattcttaaatacttaaaacttatgtattctatgtagatgtgtataaatacaaatgttctgtctaagtaataatcgtaagtccaactccaacatatctaatagccaagttaagccaagttaagacgtagactattgctagtacctgagaaactacctgtatgcttccctcctcctagccccagataattactagtctgacttttgcaatgatcaattatcagattttattcatagttttaccatctgttcatgcatttgtaaagaatatgattttgtttttcctgttttgggatgcatacagatggaatcacattatggatactgtttcttgccttgtttattttgttcaccaacacttcatgagattcatcctgttgaagcaggtagctgtagatcattccttttgattgctatatagtaggggtttttggtatgaatataccacagttcatttcctcattgaactgttgatggtatttgagttgtttctagcttggggttattaggaacaatgtttttgaaagattttgctcatgtcttcttatgagcgtgtatgtacacaagtctccctgagacggtggttcttaaaatgtagttctgggaccagcagcatcagtatcgcctgggaacctgctagaggtacaaactctctatggtcccactccagatatgctaaatctggaactctggggtgtcacccagcaatgtgtgtttgaacacacccttcaggggattatggtgcacattaaagtctggttcacattaaagtctggaaccaccactccagggtgtatatgtaaaagttgcattgctggatctgtgtatatgcaatctcagactttatttggtaaaatcaagcttttcaaaatagttttgctcatttgtattcccacaaatatgagagtttacataatctcacaaggataatatatactttaaactccaaaactccagacaacatcttgaagtctccttacaggcaaagtatgatctttgagaatgctggcctattaaaaaacacttaattacttacaacaaaattttttcacttaattagatagcggtgaatgttacgaataggtaactatacaaaatgatggatgacgtgcaataatgtgaaatgaagcattgctttagcacaccattttctcttttaaaatcctcagcaaaatgaccagagatgcacaatgcaactgcttattcctcttctcctttgtgattaatctgtggtttgtcttggagtcccccatttttgaagaataaaatgtctcatcttttgttctcataaagcatagaaaacttgctcaagaggcttatgtgcttgcaaccatacagaacagtttatgttccaccagctccttggatggcaataagtgtggttaaatgccattctgtcttttaaagaaatgcaagctccacaactaccaatactgcacagaagtgttttcatggtgcatatggtgatgagtgcatgcttgctaactgctcccagtgtgtgcactgtcttacagacaacagtgacctgcaggaacaactggggtaacatgtcctgatagaatacatcttggaataagcacatagggattggcctccctttgccctcttttgtggaagtcctcactaatgtgtcaagaggaaaccatgtcctacatgagagacctcacagacacctgtgacacaatagcagatggcaaggcagcaagctttccacatcctagtgaccccaaagcaaaggacccaactgtgtgggaggtggttaatctgggcatcctcttgggaaagaccaataccaaacagtgtcttcaggacggtcgaaaacaagaaaacatgagattgctccctgagacatgatttttatggattcatttgctgttagggatggtattccattttaaggcttctttctctagttagactagctctctgagggtgaaaccaggcctcctaggcatttgtctccttccaagtgaatagcccagcatggggcatgccctgaggacttgtcagcactgtccaaagccaggaagtcagatggaactcttgggttgggtctgagcaatgaagtgcatacctcctaattttaaagtgatcagattcagagaatgaggcttataaaacagtattttccatattacaattaattctagagataataatagaaatattgtccaaggaaagatttgtttaggtgacagaaggaagagtaagggttacctttgaggaataaatattacctgaaagagggtatgagggactcttccggggtgctgagcatgttctacatcttgatctggttggtagtaacatgccattcacatattaaaaacctatcgagctgtatttgtgcacattcatatttatgtacattactatatatgttattcctcaatgaaagtaataacaaaagacctcatcatttttgcagaaacgcactaatatgagagttagttacattcactgaatggggctgaaaactcagcaacaaagtccttcagaagaaagttctgaagtgtttaacttttctaaatatctgaatgccaatgatctcatctgaccaccacaacttccctgtgatacagcacacagtagtaataaatagtgtttattgagtaagtactataagctaagtgcttagtatccaaaatcctattacatcctcacagcaattctatgaagccaatattattattctttccattttacagataaggagactgagattaggacagagtaagtaacttgtacatgggcaggagctgtgagatgataaattcagaacttgctcacaggactatccaatgtcaaagcaggtcctctgtattactccattcttattctgccataagaacatacccggactcggtgatttataaaagaaagaagttcaattgactcacagttccacatggctggggaggcctcaggaaacttacaatcatggcagaaggggaagcaaacactaccttcttcacatggcatcagcgaggagaagtgcagagtgaagtgggggaaaagccccttataagaccaacagatcttgtgagaactcactatcacgagaataccagcttggaggtaactgcccccataattcaattaattcccactgggtccctcccaccacacatggggattatgggaactacaatacaagatgagagtgggtggggaatataacccaaccatatcaggtggtttcaacttgcatgcttatttttatgaccctccactactgtaccactgtgtgcaaactgagcatctggatctgtgtgtgtgtgtgtgtgtgtgtgtgtgtgtgtgtgtgtgtgtgtgtgtgtgtgtgtagcctggtccacaggaaatactcagcaagtattggctggtattcttagctattatgggtaaagttgcttggaggtcagttagcagagaagttgactgagtttctggtcacctggcaggagttggcagtctttccggagttgtagcagcatttaacacctgagaatttctgttcacttgaaacttcttcatttgaaggagctttagcacacaaatcagagaccttctgcctaagcatgtccagccatctttaaaaaggcttcagaggtggctcattgaaggctctcaaaatctataaccggtgatgaggtactgttcccataaccctaaatctatccataggaccctggtgtgataaattagattcctggatgcatttcctctcatctacagtccctgtcagaggatggatagttacctttacaacactaaagaatacaggtgtttaaacaaatatgatatttgaaagcttataagaattgggtgggcatggtggttcacacctgtaatcccagcactttgggaggcccaggcgggcaggttatttgaggtcaggagttcgagactagcctggccaacctggtgaaatcccatctctatgaaaaatacaaaaatttgctgggtgtgattgtgggcgcctttaatcccagctactcaggagactgaggcaggagaatcacaggaagcagaggttgcagtgagccaagattgttccactgcactccagcctgggtgacagagcaagactccgtctcaaaaaaaaaaaaaaaaaaaaaaaaaaaaaagaactgactgagtaaatgtgtgaacatattataatatgtaaactttctcaatatagagtaaaagtgggaggtcagactctggaaacagacagccttgttccaaatctactccctgacccaaaccaagatcaaccctgctatctcactgtgcctccattaccctctctgtgaaatggaggataataactgtacctacctagtaggcttgtgatgaagatttaatgaattcattcataaagcacttggaacaggtcttgtcatgtggctagcaatcaatatatttttactcaataaatagaatgcaaaactttgggctcctgttgatttcctcgctctggatacttcccccgggatataccaaattgctcttctaggtgtaaacatttccagaaacatttctgataacttttctaaattaggaatttccacatcaatggctttcagaggtcatccacataaccctggctttacacaaggatattgcaaggatttcacagggttgaattgtttgaaagaaatcaatttccagagtgccatttttctaacaaactcaaactgctcttttcaggggaactcttactgtgattcagtcacgccacaataatcaatgccggcacagaggaaatccagttcatcacattctccagccacttccaattcaccaatctgggattgcttgaagcttagatggaggctgttgtcctctgtaataacattaatagcacctcttcactctcaaggagagcctgttaaattttatgcttaggagattttagcaagaactccctaagatcatacccagttttgtaaatgtttacagatgtttttctggggcgacatctaaaactttcacaaggttctcaagagagtctactggcccaacaagattgaagaccactattttaaacaaacagtggacccttctccacaccaaggccaaactccttcattctctcatttagaccctcactcctacatactcaaactttggtgtttccactcaagtccttcagcctacatctacgctcaagtctgaatcttcatctgtaaaatatcttccctttagcaaccaccctaccttccttctgttcttcctggctctacttcctcaaactctaagtacttttctaccaattatggtctgttttttgctccttgccctccagcaagaccctgatgatgctcagtgtctaatgcagtgtacacattctaactctgatataaactctgtgtgtgtgtgcatgacttgatatcatttggatagcaatttatggcagaagcatcctctggtctgactctgaatctttttacaattgagaactgaaactattacttgaagctcttccttcctttggacttgatgatatcattcactttttcttttcctatctcagggtcttctttctcaacctgttctgtggcttctcttctccacgcagcaattcactttataaataatcttgaaagaatgaatggatggggattggttttggtgagacactattccaagcttggctctgcctctgactggctgcctgactttgagcacctccctgggcctgtctgcattcagtctccttgccaatatcatggggagactgagacgataacataatgactgtccagcacagagtagatgctcaataaattagttgatctttctccctgcaggcaaatattgttctcttaatgacacccagtgttttgatgaccattgtgatgttgcaaactcttaaacacatatctgtttgaggtctctttacaactggagacttatttttccctttgcttaccaggcatctacatctgaacctcccatgggcaccccaaaggtcacaagtatgggtagccctgtacctgtcctctgagacttccttttgcagtctctccagctacctacttagtcttctgaaccagccacctcaaagtcgttctgtaaaccttccatttggtggttaaacccttctcacatttaattggtaaaaaactccttttgatttgaccttcctctttgctctcacatctccatctccatggacactgctacagtccagacctccactgtttccatgtgagagtgaacattgatctataatggtctcccagcctctagtctcatcctgtttcatctggtagtccccattgctgcagaaagtagcagttgccaatatcatggggagattggtataatacgttgaatgtccagcacagagtagatgctcaagaagttagttgatctttctccctgcaggcgaatattttttctcttattgacacccagtgttttgatgaccaccgtgatgtggcaaacctcctaggaggtgttgcatcaccttcctagaaagtacctctttacttctttcccatatgtaaaatctttcagttactctccattatctagagcaaggttgctcaccctagcactgtcaacatttggggcagagtctttgccgtggggactgtcctgtacagtgtaggatgcttagtggatccctggtctccacctaccagatgccagtagcctgcccccttctccagttgtaacagcaaaatatagaccttgccaaatatcccagggagggggcacaaagttgcccccagttgagaacaactgacctgcaaaaataaaacctatattctctcttggcttatgatatacctcaatatattgtacccaaatatcttcaacttaatctcctgaaactataactcacacagaccctgaaatctcttatagttctacaaaaagtttattctttccaagtataccccaccttttatgactcccagactaaagtgccccatttttctactttttgtcccaattttctactggagtacctttttgttcttatccttccaaactaatctcagataatttctcctgttgtaaagtcttccctatctatactataaataatttgtccttcttccttatggatcctacatcacttgccatctattataggacttgtcactgtaatttcttcctttcacaaatgtattttaccctgaccactactaccatctacttataactttttgagtttagaaaagagattctatatatttagcatgtagtacaatgcccaacacatactaggagtattgacagctattagatagacgaataagggaatgactaatgactgaatgagtgaatgaatgacgtcacatgcttctctccccggcatggaaatgtgttgcatgttctgcatgcagagtgagttgctggcttcatgtcaagggggaatcgtcctttaagaaaaggatctgagctgctgttctccatgttacctgaaatcccacctcttcctgaaacttgctctattgagacttgagtttcaacttgatgctagagacagttgtttaaatttattttttattcattgatgattgcaactgtaatgtcccagtcataaaaataaccttatattcaataaatcccactcagaaatattctgcatggggctctgcttagcatattgatgtgaaatttatacccaagtctattttggaaaacatcaaattaaacttgtaagtataaaggaaataagagtgcccttgacctcccaagatttagatgatcagcagtttttaaattacatttcttaaaagcaaactttgatttttaaagcactgggcacgaggctgtaatcaaaggcactgatgatatttagatgatttagaagagcacaagctgatctgccaacattcagcttgcaggatacatttatcttccgttagtagtatgaaacacctttgtttttatattgattatattactttagaaaattataggttttgccttgttatattacttacagtcaaaataaatgattatggataattataattacaagaagcagctcattaaaaggggctggttttattgaggctctgctttatttctactggaataattttaggcacacagcagcatatcaaataggatgcatcagaggatgattttaggaacttagttcaaaagccctctcaggattttgcatacattttaaataatattcagctaaacacgtaatcacatgtttctcatgtatttccaaaaatcccatatggttagaaatgcctgccaggtttctctgttttgataaacagaatgacatttaattaaacagtcctgaaaaataccttctttcttgactttatactcaggagagttaataaagtccccatttcagatgatgaaataatacatttcctgcccctattctggttttctgcctcaaatgtcttcctggagagactccacatatgccagccttctcaagagtattaaaccaagggtagatggtagctagtgttctttgatctcactgtactcgttgttattcatttttttcttcttctttttttttttagatatgggggtctcactatgttggccaggttggtcttgaactcctggcctcaagcaatcctcccacctcagcctccaaagtgttaggattacaggtgtgagtcatcacacctggcctggttggtattgatttttaaaaagtgatttgttatttgttgtccatgaaacttggtgtgctctaaattgtttgtttgtttcactacatgacattccatatacttaccatcaattccaattaataggaattccaatagaatggctgaaacaaattgagtagaacaattactaacccctttagacattattatgttaggttctacactggctctatctatgggtcactgcatctgttctacactggctctatctatgggtcattgcatctggctatttagatggcaaggaaatgtaattgaactaaaaatcctagtcattgagcaacgggctgtttttgttttgctttttacctgccagctggctcctcatctttgaggtttgctctgacagctctgaagcttgggtaatatacaacaatatagacaaagtaaggaaataattaggttgtatgatattaatatattcccaacctgaaaaccacagttttaaaatattcctattgtctccccgtcctctgctcatttgacagttaccaggagctttgggcagagagggagagaagtgcatatgttgtcacctgccgctctgctgcctccatagcccatgttaggaattagcatggtgtagattaagtacaactacacaatagtcatcaattcccaatgttatcgatacattagaaaggggctttgatttccaattaagtactgaataattgaaagaaacatgtgttgttgcaggttgttgagaaacacctctacctccatttaccctttcattaagaaacagggataaaaaatattgcgatatcaggatatctagaatttggaagatgtggaatcatcctgctgagtccaagggcaatccagaaaatcagctgtgattcagactgtggtgtgccccgtggaggccatgggtcatccaggagccttgtatacctggaggatgaggagccaccaggggggaattcattctaacgtaaaaaaatgtcatcctggcatagtgacttcgacccagttcaaaagcccgggttgttgaagaggagccaaattctaggcatggtgtgtttacagtgagtgctgtgtttcccagattttcccatccatccgtaaggatctgcacattttaggaagagagagagagaattcagaataagagctgaataagagtgcagtagtaggttagctcagcagatctgtgttgtccaaaccctgcactttccaaagaacatctgctctttgacagccttccaggagataacctctaagcccttggaatatcctgcctgataataatgtctttgtttacctggagctttgagttatgctagatagttaatgctaacaatgtgatttatagtggaagctttgggccacctgtatcagtcttgacctctggaggggctggcaactgagttcagtcatgcagacagtctgccatgactacacgccccaaaaccatactggatgccagggttgggggagctccctgggcagcaatgctctgtgcatgtttcctcacctcactgctgggagaattaaacatcatttggttccatttcccagctgctgaaaaactgtaattcttttggggagaaattaataatgtagcttaaaaggaagaatgttgattgtgtaaattctgtagaatttttttaaaatgttgagggaagaagggaagaccaactatgtagaaaagggagcctttattatgaacacacaactctttataatacccatgtagaataaaagtaaagaaaaaataattcagataatcactacgtaagattatgtttactcttacatgttacacttacatattttattttatttgagacagagtctcactctgttgcccaggctggagtgcagcggcgtaatcgaggctcactgcaacctctgcctcctgggttcaagtgattcttgtgcctcagccacccgagtatctgggattacagatgtgtgccaccatgcctggctaattttttctgcgtttttgggagagatggggtttcgccatgttggccaggctggtctcaaactcctggcctcaaatgatctgcctgtctcagcctcccaaatggctgggattacaggtgtgagccactgtgcccagccacttacatgaaacatctgactgcactgctgaattcaaaatatatgaatatgttatacagaaaagtgttttgaaagtccagtgaaaattaataaccaaatagaatgttctacttagtcatttttgacttatctttataataattttgttttataatgtgaaaaaatagatctattgctcatcttgtcaaaaatatttatgtacagaactgtattttaaaacaagcaagtacaaaagaaaaattaagtgtatgaatattttattacctctcaaaatagccttacttgaaaagaccatcactccatggccaatggatctacttgatcctgaaataattgtgagtggggtgtatctgttactatcagcaggccaacctcacagcaacaagaagaaaggcctttgacaacctgagggtcaccactgggatttctatggccaacttaaatggaaagaatgagcaggaaaccagttgactttttttgaagaaaaaatgacaaaaatctctcagtacctcttagtcatcatttcttggaaacaactatacatcatacagttgcaggcagggaaataaattgaatatgtactttgtaagagagcttggcaattagcaagtggcaatgaccatccctcaaagttataaaggaagggcagtccaatagtatagttttgtatttggggcagtattttcatagaggcatttgagcaacatgcattaagcagaggcaggccgataaacgggtggctctgttctctgcaaagtcatcaccacttttgtgacactcctgaagcatacctcttcactgcctgccagtttactggagtccttgcatcactgtagtacatccatcagtacagcctgttattcctgctgaataaaggtagtacagaataacagtacagcctattattactgatgaaagttgtcagtattgaggtccaaagaggagtctgacttttttttctaagttaaaaatagtagcatggtacataaattaaagcaattcttttgcatgtgaatttctgctataacagtccctcaaaaacaagaacttgaaaagaatgataattcagcctcattgtagctgaaaggatttgaatggtatttcttgacattttgttggcttagaatgccacagaatgcaacggacacagggacatttattttgttacagcatctttcacaagtgaaattccccagttagactataaataaaaacagctgtgcaatttcagacacgttccacaaaccgaagatgggtcaaatttaaaaatgaagcagttattgcggagtttatgttcctccagcttttaaatatcattacaaacaatgtaataatgcattttagactaggagtggtttctcaaaagtgaaaccaggagattccaacattaatctagaaaattgattttggtttgtatcttttgctactattattatgaaaaacaaaacaaaacatatagagaaaaattatatttctatcaatagaactattaagttacacatttgattaaaggtattttaaagtagactcacaaatggaatgagattgagagtgttgatatctactgaaaagccgagtttgaaaatgttaaaagtctattatttgaatggaagtcatttattattcagagctctctgagatgctgtaaatattttataaatgatacaaccagcctcatcttatgagagttctgcaatgctctttaaaaaatctcgatgaattaagtgtcattcattcaaatacaaaacagaaatagagataaattacgagaactgctgttttttttttttttttttgagatggagtttcctctgtcgcccaggctggagtgcactggcgcgatctcggctcactgcaagctccgcctcctgggttcacgccattctcctgcctcagcctcccgagtagctgtgactacaggcgcccgccacactaattagcccgcctggctaattttttgtatttttagtagagacggggtttcaccgtattagccaggatgttctcaatctcctgacctcgtgatccgccctccttggcctcccaaagtgctgggattacaggcgtgggccactgcgcctggcctatgagaacagttttgttgttgttgttgttttgagacagaatctctctctgtcgcccaggctggagtgcagtggcgcaatctcagctcactgcaacctctgcctcctgggttcaagctattcttctgcctcagcctcacgagtagctggaactacaggcacccgccaccacacctggctaatttttgtatttttagtagatagcaggtttcaccatattggccaggctgatctcgaactcctgacccgtgatccacccaccttggcctcccaaagtgctgggattacaggtgtgcgccacctcgcccagctgggaacagtttttaaaaattgtatatggtagaggaaggaaaacacctttaacttagtaaaggagtcttataaatgtaagaaatagctccctaataaagataagaagatagtccatgacctcatggcactttcaagatcaaattaatcaacccagtgcccctgccaacctcaatttagcagaaactccaggtagttaattaccttgcccaaaattgcagatgcagttggcatctgacacagaatgtgtctcctaatttgttctaaacctcatccgttttactatattattagaatattagactatatatgtattatatattaatctacccaaaaatgttatagttggattcctgaaggtgccttttgggagtaatgttctttggtttctttctagacatattttctttaactaatcagccctttcctctgagtagtcccaggtcatatggcactggtaagtaaggctaataattttctatgtttctaattggggagaagtttcaggaactctgcagcctatacagagaaaggagttccttctcaattgcccccaaaactgcagctcctgatgcaatcactgtaactcctagagcactgctttcagagattttgtgaggcagttgacggtgatgttattcagaagtccttttcttctctcctattgacagtgaagatcataaaattagatctccgtctccctgtgtgtttcacacatcactagagcccctgcagatatcacactgacccagtctaattgagttccatgtgtgtctgcatgaacgtttcccagctaggagagaactgactgataatgaactaaattcgtgactcacctagacaagatttcaaaggttaggtcatgctaataaagtgtccctgcattatgattgtctatagatttctatgcacaaagataaaattaaattcagccacaaaattacatactttgagaaaatatatatatataaaataaagattaaataaaaaaatatatataggacctgtagatgccgacaccacgaggctcctctgagggcctgagtcccgggttcttgcaagagcagccagcccgcctgcccgtgctcctcgctgattggtcggctcagtgtgcatgcaggtagtggggccgtgtggggccacgccccctgcaggcatgcccatggtagctgaggacctagggggcaagggtggctctctgaggcctctgttcccacaatattccagctcctcatcctggcaaaggaagcaaggagccgggaatggggagtgctcggaatcctgtcctgaggaatgaaggccaagtggatgggccctaggacctcacccccgggctcgttccagccacccttgcccctttgggtgcaatggccatcaccccgtgggtggggcccaggctccctcccatgccctgtgtgcttccaacacgcccagctgcatcctttttatcaatggattgtgcttttatgttttatctaagaaaattgttgactccctgctatagactaaatgtttctccccagcatatgtcactctattcaatccaccaatcccaccactgggtatctacccaaaggaaaataaatcattacatcaagaagacaccagaactcatatgtttatcacagcaccactcacaatagcaaagatatggaatcaacactcaggtgcccaacaacggataactggataaagaaaatgtggtttatatgtaaaatggaatagtattcagctatgaaaaagaatgaaatcatgtcttttgcagcaccacgaatggaactatagaccattattttaagtgaaacaagtaaaacacagacaaatattgcatgttctcacttataagggaacggagcaatgtgtacacaggaacatagagagtggaaagatagacactggaaactcagaagggtgggagagtgttgagaaattacttaaaggatacaatgtacattattcaggtgatgggaacactaaaagcccagacttcaccactacacaatagatccatgtaccaaaattgccctcgtagcccttaaacttatataaataaatacatgaataaatgtttgattttgctgggtcaaaattaaagggtttttgaaagcttttggttaaaatcattcctggtgataaaaatgaaaccgacaaacatttctataatacttgacaacagaattataaagagaaatgatgcatgaatacatcttaattcttgccttaggaatattctctaactgaagtacccaaaggcttaaatatgcccattttatgccattatacctctgcaatttatctatgaatataaaaggaaatacaaaggaatataaaaggatataaaatatctatgaatataaaaagtatgccattatacctctgcaatgtaatctatgaatataaaaggaaaacctttgcttaagcacacacacacacacacacacacacacgtgtgtgtgtgcacatacatatatatatttttaccctccaaaggcaacttcaattttgttagataaaacataaaagcacaatccattgataaaaagaatgcagttgggcatgttggaagcacacagggcatgggagggagcctgggctccaccctcagggtgatggccattgcatccaaaggggtaggggtggctggaacgagcctgggggcaaggtcctaggccccgttcacttggcctccattccttagggcagggtcccctggcactccccactcctgggtccttgcttcctttgccaggatgaggagctggaatatcgtggggacagagacctcagaaagccaccctctccctgagtccacagctaccatgggtggtccctgagggggagggcatgcctgcagggggcgtggccccagcggcccaccacccacatgtgcactgagtcgaccaatcagcgaggagtgcgggcaggcaggctggctgctctcaagagaaccgaggacccaggccctcagaggagccttgtggtgccagcgtctgcaggtccactgagggagcaatgtggggggtccctcaggtgttgtgcccatggtggggaggcggggaaagccggcatgaggccctttggggatgaccgtgtgaagcaccgggctgccccaggctgacctgtgaggaaatggccccagtgtcgttgtctggggcctgaatcagggcaaggccctgagggcaggccggggtgggccagggctgagagctggagctgcccaggtggttcccagggcccaggagcagccccaggggcctgtgcatatgtgcaggggttggggagtcggtgtgggtccctcctgcctggctgcccagcaggacaggacacttggggtcaccggaggtcccctgggcatccaggcgggcgagtagcagtgcccacccttgattgtccgaaacaggtgcacaccgggtgactcccactgagatagctggggagatcctctgtcatcccacagctcttccggccacacggggtcgctgggggacccaggagcagggccgagctctgtctcaatggctccgcgaggatcccccagaggccgcggagttcaggtgtgcgcggcagctgcgagctctgcggccagccccagggacaggctgtacaggccaggacaggaggggatgctgacatattctccgcgatccctcctgctcccacaggagactcggggcgggccagccccacgcttcttgaacccaccatcccgatagctctcctttcacacaccctgtttccttactgtatctttgcactcacaaggttcaggagtcacctctaacatccgaggacaaccagccatggagcccgtgggcaggaagctcatggagaagcctgcgaaggcctcacccagtggaggctcaggttacggccaaccaggaaatggagcatggagttaaaaacagtccaggggagccggaagaaggtgcacgcccaaggggacggtttgtctgctctctgcgcggggggcacacaggcagcagacagtcagcccgaggcccccagcccctatgttgctttggagttcaccttgcacgtgctaagatgcccaagcttttcaaagcaggctcaagagccttaggtttcccatgggaggttctccctcataccagggttacagatactcttagagcagctcttctcgatggatgcggtcctgacgtccaagggatctgacacgtagtgccttgtttactgggacttaaaccgcaaagagcttgcaaaaatgcctctgtaaaatggtcagggtcccagtgattccatgtatagcgctgctttaaagctttaatgggcagagagccaaaagggtccacaaatagtacatttctccacaaaaaaatgtccacaacagcgtcttcctcttaaaaaaaaaaaaaaggtgtgtcttttttattttaatgcaggaaagactccagcaattgataagcagcggaaaagagaccattttgctgaaatcgatgcggaagacaaggggtaaagtgtttaagtcagttttgcctgtcagataacgtcttctaagaaaaatcagctttggagccaagcatggtggctcacgcctgtaatcctagcattctgggaggccgaggtgggtaaatcacttgaggtcaggagtttgagaccagcctggcgaaaatggtgaaaccctgtctcaccaaaaatacaaatattagccaggcgtggtggcatgtgcctgtaatcccaactattcaggaggctgaggcatgagaattgcttgaatctgggaggcagagaagtcagctttggatcatataatcactgttctatgcagaacatttcaccatttcacataagacatttcttcttcttaaacaaacatggcattttgtgtagcattatgttaaaattttgatgtaacttttttctttttttattatactttaagttatatgggatacatgtgcagaacgtgcaggtttgttacataggtatacatgtgtcatggtggtttgctgcacccatcaacccatcatctacattaggtatttctcctaatgctatccctcccctagccctccacccccgacaggccccagtgtgttatgttcccctccctgtgtccatgtgctctcgttgttcaactcccacttatgagtgagaacatgcagtgtttggttttctcttcctgtgttagtttgctgagaatgatggtttccagcttcatccatgtccctgcaaaggacatgaactcaacctttttaatggctgcatagtattccatgatgtatatatgccacattttctttatccagtctatcattgatgggcatttgggttggttgcaagtctttgctattgtgaatagtgctgcaataaacatatgtgtgcatgtgtctttatagtaaaatgatttataatcctttgggtatatatccagtaatgggattgctgggtcaaacggtattctgattctggatccttgaggaatcaccacactgtcttccacaatggttgaactaatttacacttccaccaacagtgtaaaagcattcctatttctccacatcctctccagcatctgttgtttcctgactttttaatgatcagtattctaactggcatgaaatggtatctcattgtggttttgatttgcatttctctaatgaccagcaatgacaagctttttttcatatgtttgttggctgcataaatttcttcttttcagaagtgtctgttcataaccttcactcactttttgatggggttgtcatttttcatgtaaatttgtttcagttccttgtagattctggatattagccttttgttagatggatagattgcaaaaattttctcccattctgtaggttacctgttcactctgatgatagtttattttgctgtgcagaagctctttagtttaattagatcccagtggtcaattatggcttttgttgccattgcttttggtgttttagtcatgaagtctttgcccatgcctatgtcctgaatggtattgcctaggttttcttctagggtttttaaggttttaggtcttacgtttaagtctttaggtcatcttgagttaatttttgtacaaggtgtaaggaaggcatccagtttcagttttctgcatatggctagccagtttccccaacaccatttattaaatggggaatcttttccccgttgcttgtttttatcaggtttgtcaaagatcagatggttgtacatgtgtggcattgttctgaggcctctgttctgttctattggtctatatatctgttttggtactagtaccatgctgttttggttactgtagccttgtaatatagtttgaagtcaggtagcgtgatgcctccagcttttttctttttgcttaggattatcttggctatacaggctcttttatggttccatatgaaattcaaagtagttttttctaattccgtgaagaaagtcaatggtagcttgatggggatagcattgaatctgtaaattactttgggcagtatggccattttcacaatattgattcttcgtaaccatgagcatggaatgtttttccatttgtgtcctctcttatttccttcacattaatgttaatcagggatattggcctgaaattttctttttttcttgtgtctctgccaggttttggtatcaggatgatgctgtactcataaaatgagttagggaggagtctctttttttctgttgttcggaatagtttcagaaggaatggtaccagctcctctttgtacctctggtagaattcagatgtgaatccgcctgatcctgggatttttttggttggtaggctattaattactgcctcaaattcagaacttgttattggtctattcagggattagacttcttcctagtttagtcttgggagggtgtatgtgtccaggaatttatccatttcttctagattttctaatttatttgtgtggaggtgtttatagtattctctgatagcagtttgtatttctgtggcatcagtagtgatatccccttgatcattttttattgtgtctatttgattcttgtctcttttcttgtttaatagtctggctagcagtctattttgtttttttttttattatactttaagttttagggtacatgtgcacattgtgcaggttagttacatatgtatacatgtgccatgctggtgcgctgcacccactaactcgtcgtctagcattaggtatatctcccattgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtaccacattttcttaatccagtctatcattgttggacatttgggttggttccaagtctttgctattgtgaataatgccacaataaacatacgtgtgcatgtgtctttataacagcatgatttatagtcctttgggtatatacccagtaatgggatggctgggtcaaatggtacttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattccggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaagcctttccccattgcttgtttttctcaggtttgtcaaagatcagatagttgtagatatgcggccttatttctgagggctctgttctgttccattggtctatatctctgttttggtaccagtaccatgctgttttacaccacaaagatactcctcgagaagagcaactccaagacacataattgtcagattcaccaaagttgaaatgaaggaaaaaatgttaaaggcagccagaaagaaaggtcgggttaccctcaaagggaagcccatcagactaacagcggatctctcggcagaaaccctacaagccagaagagagtgggggccaatattcaacattcttaaagaaaagaattttcaacccagaattgcatatccagccaaactaagcttcataagtgaaggagaaataaaatactttacagccaagcaaatgctgagagattttgtcaccaccaggcctgccttacaagagctcctgaaggaagcactaaacatggaaaggaacaaccggtaccagccgctgcaaaatcatgccaaaatgtaaagaccatcgagactaggaagaaactgcatcgactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagccaatggaaaacaaaaaaaggcaggtgttgcaatcctagtctctgataaaacagactttaaaccaacaaagatcaaaagagacaaagaaggacattacataatggtaaagggatcaattcaacaagaagagctaactatcctaaatatatattttgttaatcttttcaaaaaaccaactcctggattcattgctttttgaagagtttttcatgtctccttctccttcagttctgctctgatcttagttatttcttgtcttctgctagtttttgcatttgtttgcctttggttctgcagttcttttaattgtgaggttagggtattgattttagatctttcctgctttctcctgtgtgcatttagtgctataaatttccctgatgtaactttttttttacagggttgatatccagaagctagaagatattgcaggtatgttttaggagctatttgtagtttatgaaaattgttttcaatcatacaactgttacaataggctgtacgaattagtggacaagactgtcttaaatgccttcttctcatatatagcatttaacatagtctgtttgataaatctgtattacttccttttttattgttgatgtggaatgtgagaatgcttctaataatgggcaagtgagagggatggcttttctttcatacacgtggaaatttaatgtttgggggatattagaggacactggaggagaaacagctctattcgttccttttagtgtacacacattaagtcacatatcagtttttttagcttttattttaggtttggggttacatgtgcaggtttgttatatagataaattgcgtgtcacagtggtttggtatacagatacttttgttattttgttattttgtattttgttacctaggttatagcatagtacctgatgggtggttttcgatcctcaccctcccctcctaccctccacccttaagtaggcccagttgtctgttgttcccctcttcctgtccatatgtactcagaatttttaatatgagtttttcatgttcctaatttagctattctattgtcacagctttctgattttgttttctttaaagtatgagaaaaaattgaattctctaaaatgattattttctattattattccagtaataaactgtgtagtagaaaagtaaagacaacttttctacccagtgagaaacatgtaattaattggatccaaaaactcataaactttatattgccatgtgaaatattagttgtactgactgttataggaccatttattcaaaaaagtttgagaaaatttctgtagagacgatggagacaacactcttatttttaaaaagcttactttagttttcagttcttctatagcaataattcatataagcagtatatttggaaagctttgctctgcttggtggtgacaaagtgctggttttgtgagctgcctaatacatcgaccactatagatggatactgtatgtaaaaaatatttgtattatggtgcagatcttttatgactgcagaaaactattcttagcaattgatggtggatctctgatgtgaaactatgtttaggaaagcattccttgcagtaatacagttttcagaaacagcattgtggataaaaatgtcatataaaaagctcccagaaaatatttcaaacgtgtttttaagtgtatttctttatctacttaaacctaaatttttatacccatggacattgcttcttttattaaaatacagttaatagcatcaatcactagattgcttaaaaatactttattgtgtattatgttatgtctacccttttgatggtcttacttttatgtgctttacttaatgagttgtgacagtatttcatggaaacatgtcgtttgaactgttggacattttatgatgtagaaattaaagtctgtgtttgttaccctttctgcacatttaaaaaatagaaactattttaattatttgctttttttcatcatctgtcaattaagtgatttgctgttataccaattggaattggaaaactattattaatacctgaaaggttttacagaaaaggattaaatcttacttttttgaaacgatctttccattttgcattttaaatatccttctgatattgctgaaccatcatgtcccatattgatttcaatatctgcaaataaactacttttcaacattaatttttaatgcattttcatttactgtctagctgacattaaaaagggtcttgctgcaaagagaaaaaggattgaaagcgttgcaaaagcttgcaacgaaacaaacaacaaaattaaacgtattttgagaacaatacaactaaaaatgcatgattgttggcttttttgaataaggatatttctatcatttctttgtattcattggtgcaaataatttcaaaaactatcttgtacatattggtgtctgtagtgaacaatatgtttacttgattgttccttaagcaggtaagtttctttgttttataacctaagtttaacagaattgaggtatattatctagaaagccaatgaagatgacctctttttgccttccagataaaaatagtcttcctgtaaaattaatttttatccatttctagaaatatggcagctgcatataagataaatgtcttcaacgtttagtctgtagatccttaacaatattaagttatgtagaaagggacaaccttatgtcgtaaataggttatctattttagttaaattgttttcactattccttttagaaaatcattgttgtaccaaagtggagagagagttaagtgaagtatttcttttgggaaatcttacgggatgaatggctatgatattcttgaacctacttatgagaacccacatgttatttagtttgaggaaatgaaaagtaaactgctgttagagaaaattattgtttctgggaaatttatagtgcagtaaactctcctttgttttcagcacataaagaatgtaagatagctgctctagtagtcagttaggaagggatcctttcagaatgacagtaactcatttcaccttttcccaaaaagaagatttcagctgccattactcccttgctactttatagtataaattatgtgaagtcagttttggtttgaataggattaatttttcatctctctatgacatatgaccgtgttacttattatgtgttacaggcagaaatgtagttatggacgttctctgaagttgctgactgtccttgaatcacaggtgagcagaaagatgaagaagaaagaagaaggagctgaatgcccttgaagaatacatcacaggtgagcagaaagatgaagaagaaagaagaaggagccgaatacccttgaagaatacatcacaggtgagcagaaagatgaagaagagagaagaaggagaagaactaattgttggtatcaggcttagctttacaattaacctattgtatcaatgtctcaggtagtaatggttcatgcagaaatccagcaaagaaggaagagagcatgaacccagagagcggggcccattagtggactcatggactaggggaatataattgccatgcagcattaggggtccaactgaggtcagtgtcatagggattaagaagttaaagtcagcccagatggcatatttgtgcaagagtaactttagggttggaatttcctgggttggggtgtagctgagcacattgatagagggagagttgggcagggcatatatgttggtggagggggggcggttatgatgactggctgtggaatttcagctgggactgagttaccggagcacatgggggtgggcattgggcagtgaaaagtgctccatccattgggtgttgggtccctacagattcctgagctgtagtactgaagtgagtgacctacagtgacagggaggtagtggctgtgtatgttgggaagatggagaaatagctgagtggagtggtcaggggctgggactctgcagccacattgcttgggatccaactccagtttgaccattgctagcttggaaatatgggcaaattatttatctctgtgcctcagttgccttatctatgaaaggagacatggtaagagtacctacctcagagttgtttgaaggattaaagggttcttatgtaatgggtttatttaaaattttcaggatgcgatctcacccatggttgctctttatcgttgctatcattgctattattattattacgggagatgttgcagccattgggaatgacaaaatctaggggatgactgtgtgagtgagtgccacatagaggagaggagaacactgttgttggagattaggtcaaggtgcagaaaggcaatcattgttggaaggttcatctatgtgcatactgaaatgaccaagtgtttaaaatcttagtaaaaaagaatgtttcttaggtaagaaagatctgtattagaaattaactatctgtggtcaacaaattgtaggaagggtcatcaaatactcttcatttgaaaccaagaattaggacatacatgttgaatatatataagaaagaatattctttactccatgactgatgagaaagattatgttgttttagcatatgagtggtgaacacaactgtttaaaattggtcataaatgttgtctaatagtgttcagaagtattgatttaaagagtatccatttaaagctaatgcagaattatgttttgtaagtattaaaatttatccgattttaatcactttttagttttgtgcttctagagaatatttcaagagcaacaaaagagacggcaacaagatgggaaaggaactgaaagagattgagccgccacatgagcaattcacaaaggtctgttctatttggtaacacaatacgttcttataaaatacaactcatgaacaaaaatagaagacagtctgcttgtttctgaatgtatggaaagacctttttttttgatcagtttgactttattaatatttgttccacagagctttacaggtatcctttaactgacttctaggatttatagtttttacttttttcaccaaacaacaaattcatttttataaaattcagttggccccgagagtttctttttttttttaattatcctttaagttctagggtatatatgcacaaagtgcaggtttgttacattgtatacatgtgccatgttagtgtgctgcacccgttaactcgtcatttacattaggtatatctcccaatgctatccctcccccgaccccacaacagtccccagagtgtgatgttccccttcctgtgtccatgtgatctcattgttcaattcccacctatgagtgagaacatgcggtgtttggttttcgtccttgcgatagtttgctgagaatgatggtttccagcttcatccatgtccctacaaaggacatgaactcatccttttttttggctgcatggtattccatggtgtatatatgccacattttcttaatccagtctatcattggtggacatttgggttggttccaagtggacagaccttttggttatacattataaattacttaccattttcactttgtattgttccagatttaacataattggtaagtgtatttttaggattcatgaatagttttgtgggagttatttaaaacaggaaaaggtaaattggaaattttacctggaaatataaatcttgtgtataaaattgatactttatgaatacattaatgaagatttcatattcagtttttaggagatcagcgacagatctttagtggaatgcaggaagtccataaatccttactggatgtcttttttacttgtcttgtttaaacagttttagttaaataggaagtaggcaagtgttgactactgagtatctcttttatttcctgctggaatgtaggagtgttttatggcatattccctttcaaaactattagtgactagtaatggttttacatgaaaatttgtaatcataagagatggttcagatgtataacagaatgtgaaagccagcagattattaacactttgtgaattgtgaattatctgctgtcatatagcatattagctaatcgttattggacaatgacctcttcttcatgtagatgtatattatttaggaaacaatgtaattttcttttgggaggtattctttttaataaccttgtgaaaagacatgctcatatgtcactcctctacactaactgagatgtgttaaataaactaggaaaagcgtttgaaaataaaattttcaagcaacttaaggatgatctgtacacaaacagttatttacatagaagtcacgagaagagaacatgttgctataatgttcctcagaaactatttattaattggtatgaacattaaactagaaaagttatcctgtcaatgttaatgctacatgttaccccttagggtagaaactttggtatcatcttggactcctctgagtccattatccttcccatgcagttattgcgaggcacgtttaccgctgtaatggtcctttaatttctttctttaaatccctactgaggctgccctagttcaagacctcattcttccttgcttgtattattaagctcttttctgagttatctcttctcttctgagccatccttcactgatgggcaatactatcttcctaacactctcccctttctaaaatgcttcctagcccttccctcttcccagcctgtcagtggtgcccatgtctcagttcttagatattcagagactctcccctttacatgaccccctcttaggcttgttttgccaccctctgtctttcctcccaactctccagattgacagccttccctgaaggaactcaccgttactcccatgctttgctcatgcccttccctccaaatgcttttaaaatctttctttttcttttttctttttttttttttgactgattgaaatcttgtgccaactaagtcgacatcagtctccatttttggctacatgtccgagtgagttgctcttccatagcagtaacacaagttttgtattacttttttttttattcgtgcatttgctcatgtcacaggaatacggaagagattgtgtactcattttttacgtcttcctcagtattaacatacaacattttagggactatgaactgctgaactatttgttgagggactagtatatgtttcatacgtagttatgttttccccaacttgattaggtcatatcacagaccattttatcccttcaatgaaaaccacgttatgtggactattagtgataacaaatggtcactacctggtgaaaaaatatggtattccatgatataagactgacagtctttttctgtctttggtccatcttgtctgtaacatgttcatcaagccattttattcaagcaaactacatgactgttggacctgctataataatatttcactgaaatctggaattaaaaaatttaagtatttggagctccatgtattgattacagtttttaaatttgaaataaataaccagcatcctttgaatattaaaagctgtttcctttgacatctaatttaccctgtttaaaacctgagatgtaaagtgatggtttgtcagtgaactagactttttgttttagagtattgaggacttggaagagtataatgaaagccctctttttggtgaagaaagtggtgaagaaagtcaacttaaaaaatacatcaccgtgttccaaaataaaattgtgtcggagaccataagtactgcatatttaatcttaaaaactcaggattgatgtaagcactggaatattttatttgtagaaatgtatattgcaattacttaaatttctttttttgagacaactgcagtaagagttggcacttattcagatgtctctttaaccactgttattctgatggctgatgaaaaaacttgaacctatgttatatgatacaagcataacttgagctacactaaaccacatgacagtatttagttaattctcgtataaattagtgtatctcctctatcattagtttgtttgttaaatgccagacctcgttactgtgatctgttgaatgaaccctagacagttctgtgagaaagcagcaattgcacagttatatacatggtcagttaaattttaacattaaagataatttagttttaggtttggcctctgtggatctgtatccgttccaaaactgtagaaagcacaggcatggaacagtacatttttctctaataaaagaagacaaaacttattttatctgtgcattctttgtatttattcattaggttaaagagacaattccaatgaaagtatgacttcaaaaaatagatatactctatggcctttcaaaattattaaacttaccttaacatctgtgttcttgaaaaaaattaaactactataaatgattgagacaactgagcaggatatataaatgtcagtgctgagccattggcttgtgggtatgtcatttccaaagacatcaaaatgccatttagtttgttttggtccaccattcaatgataccacccctcagcattgattcaaagtattttattaacatttatgtatgcttaacaattacttcacatctatggcaaggtaaattatgtagggtgctttgttttttaagtttagtatttgtggagtatgtggaagttagtttaagtatgcatgcatctaaaatcttgtatgatgaactctcttacctttcctttttaatgtgcagtttttgcacataacatacaaaatgttcatttggaaacactttagtaaatatgaaattcagaatatatttggaataagtcagttaaatgtattcttttgctgagtttctgaaattccattcatgaattgttcagaacacaataccctcattgggaggagaggagagacttactctcattttcccttgttcttttcattttaattggcccctatataccactcttatcttttcaaggttttccaagttaaagaaaaaaaaagttcattcagattctgtttttctgcctacagtcacttatacaggaataagtgaatccttatggggagcatttaattcttaaagcttgcattttcataaaggattttccttttacccaaagcatgtgttgatgtgtaagtctaagtactacttcaagtttctaagaagatccttatttgagatctctttcagtagttacagaggcaaaataagcactgcagaggtccatgtgagagttctattatacatactgggctatctgactattctacagtggaaggatgagaaagacaccacaaggtatttagtgatggaacagttgatttatttttatttttattctttttgagaaggagtctttctcactctgtcaccaggctggagtgcagtggcatgatcttggctcactgcaacctctgtctcccgagttcaagcgattctcctccctcagcctcccgagtagctgggactacaggcacacgccaccacacccagctaatttttgtatttttagtagagacggggtttcagcatgttggccaggatggtctcaatctcttgacctcgtgatctgcctgccttggcgtcccaaagtgctgggattacaggcatgagccaccgcgcccggccaaaagttgatatttatgtcaccccttagtacctcaaatgagtaactgtgtacttgaagtcactctggcagatattctgaagggaagaaagtttttgaccttaaaagttattaggagtgtgtgtgtgtgtgtgtgtgtgtgtgtgtataaatgtgtgtatatacgtatatatgtgtgtgtgtgtatgtatatatgcatatacatgtatgtatatagataatatgcatatatatatgcatatacgtatatgtgaatatatgcacacacacacacatatatatgactttgttttttagaattgtttttagttcacaacaaattgatctgaaggtctagagatttctcatttaccccctgttctgccaccatagcattccccactatccatgtaccccaccagagtggtgcctttgttgcactccatgaaattacattgacacatcattatcaccccaagtccatagattacttcagggttcactcttggttactttttgtgtgtgtgtgactattttcctcacatctcttgtgctatagcccctgttttattttttcattaagataacgtttaatttatatatttgtgaccatgaaattttaggttaggatatcagaaacaagtcgcactaaaacaaacgtaaagatacacttttctcaagaaaatggtaagacaggtaactttaatttacatacatatgcttgaaaaattgcagttagtgcttttaaattctagactgaagcacgtattttcttttattccataataaacacccgctttgaagaatggctgatatcaagagcatcatgtctcctaatattgtctcactcagcagctgaatgttaaaatgcaaagtaaaagcactaaatatatccttagagcagtgatgtactgaacaaaattcagaggtcatatgcaaagacagtgcccaagaaattttgcccacagaccagtggcaagtcctttatttcagcaactgaaactgaagagaaacagtcttttgcctccctgcctcttggagagggtttctcctgatagcagagggaaaggaccatctcatttccctgatgttaaaatttcatcttggagtcctaggcttatatctttgtgaagatatctaaattaaggtgatccagtcaaatcacaaaatacttgactcactccttaggaggagcttaagtctgccctgatttctgtgcatacacctgatttattgcactcagagtacaaaagctctgagatgtcaaattgagccaggccgcacattgcattcttatccaggtgaatcagggctctctcagtgctgctcacccaaagcacattgaaataatttttcttatttatttgtaaaacagtgatgatggtatctgtgtcagagggttactgtgtcacaggaaacaatgatggtgagaaggttagacatatggtacatgttgaataaatgttagctattagttaccaatatcttcatgatttttattgatatataatagttgtaaatatgtatggagtaaatgtgatattttgattcatgaatatgtaaagatcaaatcagagtagttgggatattcatcacctcaaacttttatcaattttttgtgttgagaacatcgcaaatgtcttctaggtattttgaaatacatgataactacagttattcgagtgtgctattgaaccctagaacttatttcttctctctaactgtatgtttgtatccattgtccagcatttctttatccccgtcaaccctgctactgtttccaccctctggtaaccaccgttctactcactacctccctgagatcagtgttgtccaggaatgaaaagcaagtaaatggtaaagacaggccgggtgtggtggcttacacctgtaatcccagcactttgggaggctgaggccggcagatcacctgaggccaagagttcgagaccagcctggccaacatggtgaaacctcatctctactaaaaatacacacaaaaaaaaaaaattagctgggcttggtggcgtgtgcctgtagtcccagtgactcagggaggctgaggcaggagaatcgcttgaacccaggaggtagaggttacagtgagccaagatcatgccactgcactccagcctgggcgacagagggagactccatctcaaaaaggaacaaaaaaataaaaaataaaaaagatgaactagttgatagttaataatcatgactggtctatttgtctgctacactttctttcctctatgtgtggcaagtgcctacttactcttttaagacttgtgtcaaagaccacctagttcttcaccttttctggaccctgttagttctcaaacaaaattgtgccccctttcctctcttttagtggttctgtacctctcaaaccctgtattgtggctgttatttactgaactgttaccctagagtgtaaaaactttatcatagtcctaattttatttttggaaactggtatgttcccagccatacaggaggtgcacaatacacacgtactaaataaagtaatggtcatttgaaagagtaaatggtgaatacacagcaattctccaatctttgtgtttatgcaaacacaagaattaactttattggcctaattcaaacgttatcttgaaatttattcaaagttcccattttccatgaattaaccagacattttttgttactagattttcactaattaaccagttaaatctcttttgtcttatatcattttaaaagagcatgtggaacaaattcaaacaacttaggtagttcacgtctgtttagctcactattttaaggagtgaagttcaccccgccatttgcctacttgcctcagtactcacacaacaattgcactgatgtcctgctaatgcgcattaaatcagatatccatacctggctttgaagtgtgccctattcaacaaacagctcacttggttgttatcttccatctagtataaagataaaatatgtgccagagaaagatgtcttatagagattttcgtgatgtactagttacccataaacaattaattactggggcagacattcctaccttttagaaggagaaggcttgttcataggagttgagagtgaagaaaattaattcttgttgaactgataaatgtcccttctagatagtttacattgccattaaagcataacgttgccattttttctttatctctcagctacttatttcttgcatgagctattctggcttttaaaatcatattttttggtcatttgccaagtgcttggctgttgggtacacatggaataaattatccagtaaaaaccatctcagatctttccagctatttttgatcaggtacacctgtaaatcttaaaaagcctataaagaaatacctaactagtacattggatacaagacacacaaatctcacataggacaatggtaactgaagttctgaatgttgactcaacttaggaaattgcagtccttagggggaaaatatccttaaacaaaggcttaaaattctactaggtggtcaccaccgtttatacacatatgtatttccctctttttatttgggaaactgatggtcgtatttccttttcagggtggaagaaggaattctccattaagagaagggaaggaaaatataggaaaaataaccactctttgaaagcatctattgtccaaatcatgaggaagagcttgtagttctgagtttcacaaacgtgatttagttgtttttctgtaggatcctgcgtggggtcacctgtttcacgatagctgtgtcctcagacccagtgtaggagaagggtaaaaaatgtgttacttcactagttcatacctctctgagcctctcttgaaactgctgcagggaaaatttctccatctttgttctgtcacttgcatatttggagcctttcctactgcccttgttatgctgctttgctttgttttacagcatgcattttttccattgccaatgtttgtttgtatttccagggtctagcacatgactgtgctcaaatatcaagtgaatgaatgaatgtatgaatgaatgaacatgactttcagatgtcctttatggcttttctcattgaagtatatgcttgttctttacctcttcaaaagaggtgcaactcattgagaatagggttgccaaatgttgcaaaaactaagcatagtcttacaaaactaaacatagctgagccatacaatctaacagttgcactccttggtaactacccaaatgaactgaaaacttacgtccacacaaaaacttgtatgccagtgtttaaccagctttatctatcattgcaaaaatttggaagcaactaatatatccttcaatgggtgagtgcataaataaattatggtacattcatacaatggaatactattcagaaattataagaaatgatctagcaagccacaaaatgatcaagaggaacttgaaatacatattgctaagtgaaagaagccaatctgaagaggctgcagcctgtatgattcctgctatatagatgacatctggggtctggaggactgtggccctcttctcacagctcctctagacagtgccccagtggggactctctgtggggacttcaaccccacatttcccttccacactgccctagcagaggtttccatgagggctatgcccctgcagcagacttctgcctggacatccaggtgtttccatacattctctaaaatctaggtggaggttcccaaactgcaattcttgacttctgtgtacccacgggaccaacaccacatgtaagctgccaaggcttggggcttgcaccaagcaacagcctgagctataccttggccccttgtagccacagctggagctgaagcagctggaactcagggcaccatgtcctaaggctgcatagagccggggggccctgggccaggcccaggaaaccatttttccctcctaggcctttgggcctgtgatgggaggggctgccgtgcaggtctctgacatgccctggagacattttccccattgtcttggtggttagcatttggctccttgttacttatgcaaatttctgcagccagcttgaatttctccccagaaaatgggtttttcttttctattgcatcatcaggctgcaaattttcgaaactcttatgctttgcttcctcttgaaggttttgctgcttagaagtttcttccaccagataccctaaatcatctttctcaagttcaaagtcccacagatctctagggcaggggcaaaatgctaccagtctgtttgctaaagcacagcaagagtcaactttatttcagttcccaacaaattcctcatctccatctaagaccacctcagcctaacttcactgtccatatcattatcagcattttggtcaaagccattcaacaagtctctaggaagtttcaaactttcaaactttctaagtttcaaagtttctgagccctctgtctctaggaagttccaaactttcccagattttcctgtcttcttctgagccctccaaatggctccaacctttgcctattactcagttccaaagttgcttccgcattttcgggtatccttatagcagcacccaactctactggtatcaatttattgtattagtgcattctcaccctgctataaggacataactgagactgggtaatttataaatgaaagaggtttaattgactcagtttcgcagggctggggaggcctcaggaaacttacaatcattgtggaaggggaagcaaacatgtcattcttcacatggcagcagcaaggagaattgcagagcgaagtgggggatgccccttataaaaccatcagctcgtgtgcgaactcactattacgagaacagcatgggggtaacagtccccatgattcaattacctcccactgggtccctcccaccacacatgggtattatattcccataactacaattcaagatgagatttgggtaaggacacagccaaaccatatcatgctctaacctctaccttacgctgtagtggaggaaatgtggtgcctatttcagggatgtgacagtaagagccagatacatgaactggcatgcccaaggtaacatagagttagagagggaggggaatgaaaaactaacaatttccaagctctaaatatgcactggcactggaagaagtacttttttttaatgatatgaaatatttatatcatatacctaatacgtgtcaacacacgatccattgggatagcattttgatttattcattttacaattgagagaactgaaaatcagagaattaacgcaaattctctcaaaatcacagaactggtaggtggcagggctgacattcaatgccaaattcaagttctttccaataagcgcagttctgtcttgagaggtgtggctaagagcagaacccagatgcctatgaggagaagctggaagtccttctttaaggtcactttgcctttgcaacatgagagatggttcagggctctcctatccaggaggtgtttgtaaaacagcggacatccatttgtgcaatgcatttagactctgccctcccagaagtctggatgatgggcaagaagcgctaaggctcatttctcatccaggcaatcatggggaatgagtgtaaacagcctcaattcacaggtgcacctgaatgtgggatatggcatcaatgtttaagcccttttaaatttcttcacttgcagagctcaataaagattacattactggaaaggaaaggaaatcacctgcactgaaatatgacatgagggtggaaaagaatctaaatgtctgctggggacaaagacctcctctggtgctgctacacacacaggcaaatttccagcctcatgggtgcaaaatggccatatccagtcccctactattcaggtggtttttagcccacacaaagttttataaaaagttaagtcctaatgcaaaatcttggaaagttcacatacatatctagagttccagcctcttgaggaaagtggaagagctggcaacactgggtcccacattcctcacatgtgccccaaggcagcataggcacccaaccctgggccactgtacccacttacattacctggtatgcctcagagtttgtgaacctaccctagcctaaaaggaaggtcctagcttattcaaagctttgaaaaaaatcctgctgagaaaagactgaaggaatgctttttggcaccatctcctgtttcattagccacagctgccttactatgtatttggaccaataaaattgactctcggagaaagcaaaccaatgaaattcataggcaatgaggagagctcaatgaaaaagtgaggggaaaatgatttaaaaagatacacttgggtggcagagtagggaagtggccctttagaaactgcatataatctgtgccaggatttctcagcctaggcactagcgatatttggggccagataacttttcagtggagaatagtcctgtgcttcgtaggatgtttagcagcattccctggcctttatctactagatgccagagcaccccaccactgttgtgaccacacacgatgtctctggacatcaccaaatgtcctccagggactaaacttactccagttgagaaccactggtctatgtataactcaacttagagagcagctatgaacccaaatcatgtaaatgtgaacaaaacattcacattttcccacttgtcacaatgctcaagttatactttatctcagtttctgttttaaacagaacaatgtaaaagtgtttacaaattatgaagcctttatgtatcacactgactttgggacacaatagcaattttctttaatttacgaagaaatgggagtctgcatataattatctttctaccaaatttctaggactacagatgggggaataagccaagtttcttgaggaaatagccttgtatttctttatatgaactgtttttttctccttgggtggggcaggatcaggtatggaacaccctctgatagtcaacagttgtatgaatggatgtttagcatttagagaagactcaggagacattgtggttctttccttttatttagaggactaaacatggtggatgaagagacttactggccagccctccatgggccagaatgaaaattcaggaagatatcataggaagacagtctagccagcaaatggaaccagtggaatgagctgcctcaaaacaaagcatcattcattgtggcttccatttggttgtattctgtcttgcacccctccactttgtgagaaaccaggtcaggagcagccctatgcaaaaagctaaggggtaagtctccagctgaaagctatactagtgagcctgggaactgctcctccagccccaatcaagccctaagatgactgcagccccatctttgcttggctgcaacttcacaggagcccctgaaccagaacacccaagctaagctattcacagaagctgttttacaagataaatgtttgttatttgaaaaataaaaataaaaagataagaaaagatgcccagttaaatgcaatgtggtatcctgaataggattctggaagagacaaataacattagtgtggaaactggtgaaatctgagtgaagtctatagttttgttgatagcaatgcaccaatgttggtttcttagctgtgataaatgtaccaaggtaatacatttatggtattaatgttaccataatagcattgaggttatgttattatgttaacagggcaaactgggtaaggggcataagggaactctatactatcttcataactctctgtaattctaaaattattccaaaattaaaaaaaaataagtcctttctcccaggcaccagatgtattcaagcaaaggttggaaactcacttatcaagcatgtgagaaaatggaggcctgtattgctcactgaagtgctccacagaactgaaagctcagtttagtgacaagaagggaggtgactcacaagccaggctgaaactagtgaaataatctcctatttgcatctccttgatctgaaagaaaacatgtgcctaagctgacatgaaacatctattatgtttgccattctggtggagcctgtttgctggaaagggagtggacagctaacaagatggaccagatttgtttttatggggctggtgattttttcataggtggcttattaggttgttgtaagattctaaatcttaggttctctaaatcctttttctgcttaagttatccagacagtatttttcatttgcattcatgaacaccgattatttgattagtacagaaatctatttttaagctccaatgcctattctgtaaaccaaaatattgtttttaaaataaaatataacatctctttacatatatatgtacatataaatgtgaattgagttatatgatctgtggatatcctgtaaaaaggtttagtaataccatattttgtcctttattaaaactaaaattcattatttcatctcattatttctcactttgagggcttttctttgtggctttcaagccacagacctcccaaaaaataaggcaagagaaagactgaaccagatattttatttccagtttggaacaggaggtttgttaaagaagtaacaatattattaatgacccctggcacttgggagccattcattgtgcctgtactccatgtttggtgctttctaatgattaatcccagcaacataagttaaattggcccagtaagtttacataggaaaacaggtgttacctgaggacaagtcaggctggacaaaggatccacttactgccattgccaccccgagtggaatgaattcaaaattgctccttctactttgagttgcctgcttcatattcaaagtctatcccaagaaatggaatggatagcagctctgatagaaaagaggaatagtaatctaggaaagcgaaaccagtgggaccaggaaagggaaaacagtgggaccaatgcaatgctctggtttaagagttaacctgggatgaatcccagagatttaggaagggagccaaaacagggatctcttccctattcttaagcaagtattctctgcccagggatgttgtaccatagaacatgatgactattcttggcttgggaatattatttacaatataatagttatctgtttaaatgtcatcttccatacactgatctatccatccacccatccaccctttgattgatcaataggtgagattctgagctaggtgctatgaacccagatgaatgaatgctatctctgcctttgaaaaattcaaaattcagtgctagagatagacatgtggaaacctaattaaagcaaaatgaggccgggcatggtggctcgtatctgtaatcccagcactttgggacaccgaggcaggtggatcccttgagctaagaagtttgagaccatcctgggcaacgtgctgaaatcctgtctgtactaaaaatacaaaaattagctgggcatggtggcacgtgcctgtagtcccagctactgggtggggtggggtggggtggggggctgaggcagggggatcgcctgagccttgggaggttgaggctgcagtgagctatgatcgtgtcactgcactccagccggagcgacagagtagtgtcactgcactccagcctgggcgacaaaaaaaaaaaaaaaagcaatatgaagaaatgcttcagtgaggagaagacatttactaggtgccaggacaaaagagagaagactgcttccagttctgcttgcaaaggctaatgtttgagttcaaccttaagggatgaagttatccctctctggggtctttgaattttggtgggggtttccaccagcttagtttaggacatccttcctttctgattaccctatcccttttaatgtttgattccttataatccaaccctttaccaactaagcattctattggtgaaaaagatgagaaaattgcaaattcaggagtggattgctagtttcttaagtgggaaccagggttcaagagaggggaaaataataattgtggaagaaaacaatctatatggaaaataatggaaaacgtattcaagcccaaactggtcccatcattcaggcaatgctggatacgtgtgtgtgtgtgtgtgtgtgtgtgtgtgtgtgtgtgtgtgtgcgcgtgtgtcatcttcaagaaatctttcataccctagattgttggttatttaaccaaactcatgttatcaaagtttttgcttattaacttatacttaacagttcttccactaactttaattgaaatagacaaaggcagataggaacagggtgattggttcacttttgttggtataagtcccagtgaattaaacactttctttttcctgctagcactttgtgggctaggatttccaaaatctctttccaaagtgtctatgtttccctggagaagaaaatgttttatggtattcttaagcaatagcgatgcctctccttagggctgaggctccccaaagtacttgtgaaatgtactaatccccacagtttacatgttgaagtggtggtgaaattatcaaaggtgtggtcagaaaataagaacattctgtgagtctctcactgctgtagagaaagtcgactcttggaggtcaccatgccttcagttaaacactaagaagaaacctattctgttttgtgtaaattattctggcagggtgattagttctaaaatttttctatatcatcttcaagaggagaaaaaaaacttctggatcctcgaacctcaaagcaagtggttttctattacagaaaaatcattaagatatttgatttgttgaacacgtctccttgttccgtcaaaacatgaggtagggaagctgatctcatggtttagatgccatagctttaaaggctcaactatggtttttccttaactaggtgttctttgtaatcactgcttgctgtaagaactgctaatgatcaaattatgccctagaaggatcttttacttgctttcatttttccacagtcaagttatatgattttttttaaagaagatttttttttcaaagctttcagcacatgtctcaaaggggcagctctgctgctgacttttcatgatctaggagctagtatgtccttccaggctcctgaatttgtatctttcattgaacagtccttaaatggaggacaatacttttagtttagtctaggtaggcactgtatttgtagagacaggagtttccaaatatcggggcagggaaaatggcttttgccaagtcatttttttaagctacatttcattcctggagtgtaaatgaaaggaagtaggcaggagaacaaaaatacaaaaatcatttttccctaataaatattctaggtggttaactcaagaaaattaaaacccaaattttgggagtcttatcattacttgttaaagtcttggaaatgcctagaatttcctgccagttgctcccatgaaaacagctctctctgattcagtacctgaaaagatgatgcaattaaatgaaactattatactacctatccttttcttatccattccatgtttttgattatcctttgagccattcaaaacaattccatatgctatggaaacactatatacataaatgtgctatgattgaatttttaatgtatctcatttaatttttcaaatatttattgtgctgtaggtatgtataaggcactgtgctagacgctaaagcaaataaaataagaatggtttcctctctatcacttgtctgcaatggcagaagatgacaatgttcttccgtataccagtagtttttaatctaaatccatctctatcctgctcccctccacctactcactgcaattcttccttgctccattttgtcagttgctcatcctccatgcaactcatcctgggatgagttatcaccccaaactcgggaaatgaacccttagttcaagccaatcccagtgatttatttctacttcccagtattgatttgggcactggcaggtgttgcaattctaggacatgagaagggaatattgctaacttctcagtcatcaaacaagatagtaatagtgaaagtaataacttgtaatgaagattgacttattaaagttacccatttaatgcataactcatgtgtctatagactgcatggtggcatcagttgtttaaaccagtcataaaaatattgacttttattttttgcttaatgccaccaaaggaactcatctcaccttgaaaaaatatttggtcacatatgcagtcatgtgccacataacaatgctttggtcaacaggccatatataagacagtggtctgaaaagattataatggaggtgcttcatacagctatactattttttatcttttatgcaatatttctactatgccttttctatgtttagatacatagatacctaccattgcattccaattacctacagtgttcagtacaggaacatgctgtataggtttatagcctaggagcagtaggctctaccatatcgcctaggtgtgtagtaggctatgccatctaggtttgtgtaagtatactctattaagttttgcacactgtcaaaatcatctaatgatgcatttctcagtatgaatctgtcattaagcaatgcatgactgtaatataagcactaaaacatctaagaataacaaaggtctgatccttaaaaagcacacaattactacatcatgaaattaaaataatgaagaaattgaaatgaacaggaatagtatagttgaacaactgcataaaaaataacaatgaattactataatattaatttcaaattaggggttggcaagctttttttctgtaaagatccagagaataaatacttttgatcttgtgggccataaggtctctgtcaaaactactcaactctgccactgtagcactaaagcagtcacaggcaatacagaaagaaatggacatggctgggttttaataaaaatataaaaacaggcaatggactggctatggcccatgagcttagtttgcccacatctatcttaagtgaaaacctgttaaactactcttccagagctttccatatgtaaagctctagtaacacccactagttgaatttttaagtaatcttgagggcttgattccaaatgacctaaaaaggctgattggttaaaaaatacactcagcattaaatttcaacgtatacgtatttgcttttattttgcccatggggaaaccaagaaaaaaggcaaaatgttcatgtttgaaggatgggatattcttcataattatcaagtttattttgggctatgatcccaaaagagaatatagtgcagtcttgaaatctttgaaaggtgccagaatatttcagaaactgcagtgacagaagttttggtcaagatgccaaagtcttgtgcaatagtggttgctgctccaacaagacatacgaatatgtataaatatgaccagttgagacaagaccttggatagaaaacgatattgtctgagaacataaaggaagtaatttgtgaataccatggtacaaagcacatggcttaaagaatcccacacctgcttggcaccaacatagcatcatatagtggcagcagacacttgagaactttacatggtaaaaaccctggggtgctaggaagagcatccaagaagaaaattacaaaataacctgcaggataatgtctttgtcattcttggcttttaccagagtgggtggatgaggcagcttctatctaaagggtcaccaaagtcaacttggacagatcatctccactgctctatcttttaatataattgatgcatctgtgttttctctgtctattgactaggaactactcgatgataggaactccttttgacatagtgttgaatcctctatcgcagctagaccttaaagccccacatatgtatctccttcaggttgcataacccttggtattatgaggaaagagctgtgaggccttgtaggaagccctctgggtgtcactccctcagtttggctctagagagagaaggcataagatactcaggtatggctctagccttaggttcatcaccatggccctatggaaaaagaagttcccgtccaccttatcaaggccctgagagccacagcaaagatcaactaatttttccatactgatatttttgttgcttcctttgtgattccctgttctctattccatataccttccaagactgtgttattgaatagtggtttataacctattaataaatcaagaaaattcagtggatcatgaaaacatattttgaaaatgaaagagaatcagatagaagaggataggagagaatattataaagaatatccaaatgtatctctgataaagataagctgtttggcttcatgcatttcctgggctgagatgtaaaatgtacttctcactgcagataggttgtggacaaaaaatctgcaacctgctgttctaagacaagtaaacaaataaaagtctgtggtgcattctgagaacaggctgcaaactaaatggatttcttcttttatatgaaatagatagtatctcatataaaatggctttgatagtaagatcagtagacaatagggagccttgggatttttgtttgctttttgtttttccaacaaaggagtagccactgtggttgaagtttcactctggtgattttacgtgtggtagatagaatagaggagaagccctgaattgaggaaagtaggtaggggttctatgactataattaaaatcaagcataatgatgcagtgacatagggttgaggggagatacaggacaaagtgatatggtgatggcaaaaatgacaatgatgatgatgatgatggtgatggataagttttatggagagtatataagatgtcaggaagtgatttaagctcattatggttattatttcatttaaatctcacatcaaccctatgagaccatcaatgaaagctggaaactgagcatgaagtgaaggagtaaggaagtgttgaggttgttttaaaatcattactggagacactggggacagtgggagaaaggtgatcgatgctctttagagatatggggaagagtgagagaaagagcttaatttaaaagcttattattaaataatatgcctgcacgcatccattcacatctcaaagatttgctgagggccacttgtgtattaggcagtacagatgatgttccagatcaaagaccaataagacgtagccctactccatgggaagtcaccatcctttgtgtgaagatcacagaaaaggtgattgtggacacacagaaggtacaatcagctccacagttcacagaatagagacctttgttgagggcctctgggcacagtggtctcattattccgtgatcatccctatttggtggtgtttgcttcccattggcatttctacctacagtggattttgtggattctgcaccaggtttcaaccttatttttacttacacaaaaggctttggcagacagttctagcacatcacctcttcaactgggcattgccagaaagaataacagaaataggacagttaaatttttctgtcaagggttgttatataaacacccaatctcaatttccttgcctaccaggttacttttattttctaaatcaacatttaaatcacaaactgaagacagctgcagtgttggcctagcaagaatgtaattttccttatttcattgagttgtgtacttggatttgacattgcctaagggataatggcgagggatcattttataaggaagccatataattgagcaattttgaggcattggggtactcttttatgagactcttctccatattttcttaaaccatcagctattcctcattccatgatactgttttcaaaatgcataaacaaagcctttctcaattgtgatatcagaaatgaactgatacaagaagaaaacagctctaaagaaaacacaaatatgcatttctgtcttatagaaccattcaactgtaaatattggtttacaatataataaggttaagccataatgcctacactaacgtgctatagtgattgtggcaggaataagttattttctttcattttaccttagatcaggcatcagcaaatttttcctgtaaagggccagatagtaaacttctgagacaatgtcacaactactcaactctgacattgagtgaaaacaggcatagacgaattgtaaatgaatgagcatggctgtgtttcagtaagactttatttacaaagacagatggtaagcttggtttggccatggttcagttgctaacccctgattttgaccatttgtattaaaatgttaccaaaataatattaattggacctaacatactacttgatatacaaaaagtgctctttggatgtgttttaaataagtgaaaagtttgtgtagaccattaggttttgcttaatttcttgactattttttacatttgtttcctggttctgtgactaagagttggccatttacaaactagatagtctgatccaagagcctatgccaagagtagccatttgaataatcagatagtccatgcttgcctccatggagtaattttgggctcacagggaaaatgattggttcctgatttcaaccactaaaaatgtctccagattctcaaaagcattttcaaaagtctctttttgaaccatgttaagtttagaaggggtaacaaattaagctcatcagctattttatcttattagttattcagtgtgtacatctccaggctaaatggatatacaggagggaggagccacaagatgcaagaagcctgggtccctgaataacggcctggaagagagtttgcccttctcaccccattgccaacctgcattagatagtgcttcagtaagaaatatacttttgtagtggtgttaaggcactgagtggttagcctaccccaacaaatacaagtatgtatctgtgagatacagtcttagaagtagaatggttgggccatttaaaatttagaaaaatgcaagaacccaaaagcaaatgcaataaaaagaaagataaatagctgggacttaattaaaccaaagagcttttgcacaccaaaaggaaaagtcagcagaataaacagacaacccacagagtgggacaaaatcttcacaatctatacaattgacaaagtacgaatatacagaatctacaacaaactcaaacacattagcaagaaaaaaacaaacaatcccatcaaaaagtgggctaaggacacgaatagaaaattctcaaaagcagatatacaaatggacaacaaacatataaaaaatgctcaacatcactaatgatcagggaaatgcaaatcaaaatcacaatgtgataccaccttactcctgcaagaatggccataatcaaaaa
